(12) United States Patent
Kondo et al.

(10) Patent No.: US 9,169,488 B2
(45) Date of Patent: Oct. 27, 2015

(54) GENE CAPABLE OF IMPROVING MATERIAL PRODUCTIVITY IN SEED AND METHOD FOR USE THEREOF

(75) Inventors: Satoshi Kondo, Miyoshi (JP); Chikara Ohto, Toyota (JP); Nobuhiko Muramoto, Ichinomiya (JP); Norihiro Mitsukawa, Miyoshi (JP); Masaru Takagi, Tsuchiura (JP); Kyoko Matsui, Ryugasaki (JP)

(73) Assignee: TOYOTA JIDOSHA KABUSHIKI KAISHA, Aichi-ken (JP)

( * ) Notice: Subject to any disclaimer, the term of this patent is extended or adjusted under 35 U.S.C. 154(b) by 957 days.

(21) Appl. No.: 13/376,326

(22) PCT Filed: Jun. 4, 2010

(86) PCT No.: PCT/JP2010/059543
§ 371 (c)(1),
(2), (4) Date: Dec. 5, 2011

(87) PCT Pub. No.: WO2010/140682
PCT Pub. Date: Dec. 9, 2010

(65) Prior Publication Data
US 2012/0144522 A1     Jun. 7, 2012

(30) Foreign Application Priority Data

Jun. 4, 2009   (JP) ................. 2009-135321

(51) Int. Cl.
*C12N 15/82* (2006.01)
*C12N 5/14* (2006.01)
*C07K 14/415* (2006.01)

(52) U.S. Cl.
CPC .......... *C12N 15/8247* (2013.01); *C07K 14/415* (2013.01); *C12N 15/8216* (2013.01); *C12N 15/8217* (2013.01)

(58) Field of Classification Search
None
See application file for complete search history.

(56) References Cited

U.S. PATENT DOCUMENTS

| | | | |
|---|---|---|---|
| 5,516,668 A | 5/1996 | Maruta | |
| 5,783,394 A | 7/1998 | Bestwick et al. | |
| 5,914,449 A | 6/1999 | Murase et al. | |
| 6,717,034 B2 | 4/2004 | Jiang | |
| 7,342,148 B2 | 3/2008 | Takagi et al. | |
| 2003/0101481 A1 | 5/2003 | Zhang et al. | |
| 2003/0226173 A1 | 12/2003 | Ratcliffe et al. | |
| 2004/0006797 A1 | 1/2004 | Shi et al. | |
| 2004/0045049 A1 | 3/2004 | Zhang et al. | |
| 2004/0093638 A1 | 5/2004 | Sasaki et al. | |
| 2005/0005333 A1 | 1/2005 | Ruezinsky et al. | |
| 2005/0183169 A1* | 8/2005 | Takagi et al. ........... 800/288 |
| 2006/0107345 A1 | 5/2006 | Alexandrov et al. | |
| 2006/0272060 A1 | 11/2006 | Heard et al. | |
| 2007/0022495 A1 | 1/2007 | Reuber et al. | |
| 2008/0072340 A1 | 3/2008 | Troukhan et al. | |
| 2008/0096277 A1 | 4/2008 | Kuroda | |
| 2009/0019605 A1 | 1/2009 | Takagi et al. | |
| 2009/0094717 A1 | 4/2009 | Troukhan et al. | |
| 2009/0116723 A1 | 5/2009 | Okajima et al. | |
| 2009/0178161 A1 | 7/2009 | Arar et al. | |
| 2009/0190821 A1 | 7/2009 | Marugame | |
| 2009/0300790 A1 | 12/2009 | Aharoni et al. | |
| 2010/0311994 A1* | 12/2010 | Chatani et al. ........... 554/8 |
| 2011/0010804 A1 | 1/2011 | Chatani et al. | |
| 2011/0081691 A1 | 4/2011 | Ohto et al. | |
| 2011/0099664 A1 | 4/2011 | Takagi et al. | |
| 2011/0209244 A1 | 8/2011 | Takagi et al. | |
| 2012/0159666 A1 | 6/2012 | Yonekura et al. | |
| 2012/0159673 A1 | 6/2012 | Kondo et al. | |

FOREIGN PATENT DOCUMENTS

| | | |
|---|---|---|
| EP | 1469010 A1 | 10/2004 |
| EP | 1586652 A1 | 10/2005 |
| EP | 1702508 A1 | 9/2006 |
| JP | 60-2023 B2 | 1/1985 |
| JP | 02-035358 A | 2/1990 |
| JP | 6-090766 A | 4/1994 |
| JP | 6-217719 A | 8/1994 |
| JP | 6-303925 A | 11/1994 |
| JP | 9-182 A | 1/1997 |
| JP | 9-065840 A | 3/1997 |
| JP | 9-313059 A | 12/1997 |
| JP | 2001-059842 A | 3/2001 |
| JP | 3149951 B2 | 3/2001 |
| JP | 2001-269176 A | 10/2001 |
| JP | 2001-269177 A | 10/2001 |
| JP | 2001-269178 A | 10/2001 |
| JP | 2001-269179 A | 10/2001 |
| JP | 2001-292776 A | 10/2001 |
| JP | 2001-292777 A | 10/2001 |
| JP | 3407034 B2 | 10/2001 |

(Continued)

OTHER PUBLICATIONS

Accession No. NM_102146, *Arabidopsis thaliana* AP2 domain-containing transcription factor, putative (AT1G22985) mRNA, complete cds, Database (online), May 2009, retrieved from http://www.ncbi.nlm.nih.gov/nuccore/30688157?sat=13&satkey=2426001 on Feb. 6, 2014.

(Continued)

*Primary Examiner* — Brent T Page
*Assistant Examiner* — Matthew Keogh
(74) *Attorney, Agent, or Firm* — Sughrue Mion, PLLC

(57) ABSTRACT

An object of the present invention is to search for a gene having a novel function that can cause an increase or decrease in material productivity, and particularly, fat and oil content. In the present invention, a chimeric protein obtained by fusing a transcription factor consisting of a protein comprising an amino acid sequence shown in any of the even-numbered SEQ ID NOS: 1 to 158 and a functional peptide capable of converting an arbitrary transcription factor into a transcriptional repressor is expressed in a plant.

8 Claims, No Drawings

(56) References Cited

FOREIGN PATENT DOCUMENTS

| JP | 2001-333705 A | 12/2001 |
|---|---|---|
| JP | 3289043 B2 | 6/2002 |
| JP | 2002-524028 A | 8/2002 |
| JP | 3407033 B2 | 3/2003 |
| JP | 3407035 B2 | 3/2003 |
| JP | 3409079 B2 | 3/2003 |
| JP | 3421740 B2 | 4/2003 |
| JP | 3407036 B2 | 5/2003 |
| JP | 2004-500823 A | 1/2004 |
| JP | 2004-286666 A | 10/2004 |
| JP | 2005-013214 A | 1/2005 |
| JP | 2005-027654 A | 2/2005 |
| JP | 2005-052114 A | 3/2005 |
| JP | 3656104 B2 | 3/2005 |
| JP | 2005-192483 A | 7/2005 |
| JP | 2005-204573 A | 8/2005 |
| JP | 2005-204657 A | 10/2005 |
| JP | 2005-278422 A | 10/2005 |
| JP | 2005-295878 A | 10/2005 |
| JP | 2005-295879 A | 10/2005 |
| JP | 2005-325136 A | 11/2005 |
| JP | 2005-352571 A | 12/2005 |
| JP | 2006-006248 A | 1/2006 |
| JP | 2006-020607 A | 1/2006 |
| JP | 2006-034218 A | 2/2006 |
| JP | 2006-042729 A | 2/2006 |
| JP | 2006-042730 A | 2/2006 |
| JP | 2006-055125 A | 3/2006 |
| JP | 2006-101827 A | 4/2006 |
| JP | 2006-134188 A | 5/2006 |
| JP | 2006-280242 A | 10/2006 |
| JP | 3829200 B2 | 10/2006 |
| JP | 2006-325588 A | 12/2006 |
| JP | 3995211 B2 | 10/2007 |
| JP | 2008-502358 A | 1/2008 |
| JP | 2009-009290 A | 1/2009 |
| JP | 2009-115598 A | 5/2009 |
| JP | 2009-180539 A | 8/2009 |
| JP | 2009-210409 A | 9/2009 |
| WO | 00/05385 A1 | 2/2000 |
| WO | 01/35727 A1 | 5/2001 |
| WO | 01/36597 A1 | 5/2001 |
| WO | 01/64022 A2 | 9/2001 |
| WO | 03/013227 A2 | 2/2003 |
| WO | 03/055903 A1 | 7/2003 |
| WO | 2004/046336 A2 | 6/2004 |
| WO | 2004/056993 A1 | 7/2004 |
| WO | 2005047516 A2 | 5/2005 |
| WO | 2005/085467 A1 | 9/2005 |
| WO | 2006/056701 A1 | 6/2006 |
| WO | 2006133461 A1 | 12/2006 |
| WO | 2007/102346 A1 | 9/2007 |
| WO | 2007/117693 A2 | 10/2007 |
| WO | 2008/041693 A1 | 4/2008 |
| WO | 2010/035618 A1 | 4/2010 |
| WO | 2010/041423 A1 | 4/2010 |

OTHER PUBLICATIONS

Mingjie Chen et al., "System Analysis of an *Arabidopsis* Mutant Altered in de Novo Fatty Acid Synthesis Reveals Diverse Changes in Seed Composition and Metabolism", Plant Physiology, May 2009, pp. 27-41, vol. 150, No. 1.
Keith Roesler et al, "Targeting of the *Arabidopsis* Homomeric Acetyl-Coenzyme A Carboxylase to Plastids of Rapeseeds", Plant Physiol., 1997, pp. 75-81, vol. 113, No. 1.
Colette Jako et al., "Seed-Specific Over-Expression of an *Arabidopsis* cDNA Encoding a Diacylglycerol Acyltransferase Enhances Seed Oil Content and Seed Weight", Plant Physiology, Jun. 2001, pp. 861-874, vol. 126, No. 2.
Alex Cernac et al., "WRINKLED1 Encodes an AP2/EREB Domain Protein Involved in the Control of Storage Compound Biosynthesis in *Arabidopsis*", The Plant Journal, 2004, pp. 575-585, vol. 40, Issue 4.

International Search Report cited in PCT/JP2010/059543, dated Aug. 17, 2010.
Muramoto N., et al., "Identification of Transcription Factors Responsible for Seed Oil Content," by Chimeric REpressor Gene-Silencing Technology (CRES-T), Supplemental to Plant and Cell Physiology, 2008, pp. 152. vol. 49.
Tomotsugu Koyama, et al., "TCP Transcription Factors Control the Morphology of Shoot Lateral Organs via Negative Regulation of the Expression of Boundary-Specific Genes in *Arabidopsis*", American Society of Plant Biologists, The Plant Cell, Feb. 2007, pp. 473-484, vol. 19, No. 2.
Taito Takeda, et al., "RNA Interference of the *Arabidopsis* Putative Transcription Factor TCP16 Gene Results in Abortion of Early Pollen Development", Plant Molecular Biology, 2006, pp. 165-177, vol. 61, Nos. 1-2.
Kyoko Matsui, et al., "AtMYBL2, A Protein With a Single MYB Domain, Acts as a Negative Regulator of Anthocyanin Biosynthesis in *Arabidopsis*", The Plant Journal, 2008, pp. 954-967, vol. 55, No. 6.
Yongfeng Guo et al, "AtNAP, a NAC Family Transcription Factor, has an Important Role in Leaf Senescence", The Plant Journal, 2006, pp. 601-612, vol. 46, No. 4.
Keiichiro Hiratsu et al., "Dominant Repression of Target Genes by Chimeric Repressors that Include the EAR Motif, a Repression Domain, in *Arabidopsis*", The Plant Journal, 2003, pp. 733-739, vol. 34.
Minoru Kubo et al., "Transcription Switches for Protoxylem and Metaxylem Vessel Formation", Genes & Development, 2005, pp. 1855-1860, vol. 19.
Nobutaka Mitsuda et al., "NAC Transcription Factors, NST1 and NST3, Are Key Regulators of the Formation of Secondary Walls in Woody Tissues of *Arabidopsis*", The Plant Cell, Jan. 2007, pp. 270-280, vol. 19.
Monica Santos-Mendoza et al, "Deciphering Gene Regulatory Networks that Control Seed Development and Maturation in *Arabidopsis*", The Plant Journal, 2008, pp. 608-620, vol. 54.
Final Office Action issued in U.S. Appl. No. 12/746,577, dated Oct. 23, 2013.
Final Office Action issued in U.S. Appl. No. 12/921,060, dated Oct. 8, 2013.
V.R. Bautista et al., "*Arabidopsis* ORF clones", GenBank Accession BT029518, 2006, retrieved from: http://www.ncbi.nlm.nih.gov/entrez/viewer.fcgi?119360090:NCBI:15965543 on Dec. 25, 2008.
John L. Bowman, et al., "SUPERMAN, a regulator of floral homeotic genes in *Arabidopsis*", Development, 1992, pp. 599-615, vol. 114, The Company of Biologists Limited, Great Britian.
Xiaofeng Cao, et al., "Locus-specific control of asymmetric and CpNpG methylation by to DRM and CMT3 methyltransferase genes", PNAS, Dec. 2002, pp. 16491-16498, vol. 99, Suppl. 4.
Xiaofeng Cao, et al., "Role of the *Arabidopsis* DRM Methyltransferases in De Novo DNA Methylation and Gene Silencing", Current Biology, Jul. 2002, pp. 1138-1144, vol. 12, Elsevier Science Ltd.
Antony N. Dodd et al., "Plant Circadian Clocks Increase Photosynthesis, Growth, Survival, and Competitive Advantage", Science, 2005, 309: 630-633.
John Doebley et al., "The evolution of apical dominance in maize", Nature, 1997, 386: 485-488.
Christian Dubos et al., "MYB transcription factors in *Arabidopsis*", Trends in Plant Science, 2010, 15(10): 573-581.
Extended European Search Report (EESR) for corresponding European Patent Application No. 08 85 6425.7, dated Nov. 3, 2010.
Extended European Search Report (EESR) for corresponding European Patent Application No. 08858128.5, dated Nov. 15, 2010.
J. Christopher Gaiser, et al., "The *Arabidopsis* SUPERMAN Gene Mediates Asymmetric Growth of the Outer Integument of Ovules", The Plant Cell, Mar. 1995, pp. 333-345, vol. 7, American Society of Plant Physiologists.
Koji Goto, et al., "Function and regulation of the *Arabidopsis* floral homeotic gene PISTILLATA", Genes & Development, 1994, pp. 1548-1560, vol. 8, Cold Spring Harbor Laboratory Press.
Haiwei H. Guo et al., "Protein tolerance to random amino acid change", PNAS, 2004, 101(25): 9205-9210.

(56) References Cited

OTHER PUBLICATIONS

Keiichiro Hiratsu, et al., "Identification of the minimal repression domain of SUPERMAN shows that the DLELRL hexapeptide is both necessary and sufficient for repression of transcription in *Arabidopsis*", Biochemical and Biophysical Research Communications, 2004, pp. 172-178, vol. 321, Elsevier Inc.
Keiichiro Hiratsu, et al., "The SUPERMAN protein is an active repressor whose carboxy-terminal repression domain is required for the development of normal flowers", Federation of European Biochemical Societies, 2002, pp. 351-354, vol. 514, Elsevier Science B.V.
Yuxin Hu et al., "The *Arabidopsis* Auxin-Inducible Gene *ARGOS* Controls Lateral Organ Size", The Plant Cell, 2003, 15: 1951-1961.
Yuxin Hu. et al., "The Arabidopsis *ARGOS-LIKE* gene regulates cell expansion during organ growth", The Plant Journal, 2006, 47:1-9.
International Search Report for International Application No. PCT/JP2008/072158, dated Feb. 24, 2009.
James P. Jackson, et al., "Control of CpNpG DNA methylation by the KRYPTONITE histone H3 methyltransferase", Letters to Nature, Apr. 2002, pp. 556-560, vol. 416, Macmillan Magazines Ltd.
Steven E. Jacobsen, et al., "Hypermethylated SUPERMAN Epigenetic Alleles in *Arabidopsis*", Science, Aug. 1997, pp. 1100-1103, vol. 277, American Association for the Advancement of Science, Washington, DC.
Steven E. Jacobsen, et al., "Ectopic hypermethylation of flower-specific genes in *Arabidopsis*", Current Biology, 2000, pp. 179-186, vol. 10, No. 4, Elsevier Science Ltd.
Norihito Kuno et al., "The Novel MYB Protein Early-Phytochrome-Responsove1 Is a Component of a Slave Circadian Oscillator in *Arabidopsis*", The Plant Cell, 2003, 15: 2476-2488.
Makoto Kusaba et al., "Low glutelin content1: A Dominant Mutation that Suppresses the Glutelin Multigene Family via RNA Silencing in Rice", The Plant Cell, 2003, 15: 1455-1467.
Hon-Ming Lam, et al., "Overexpression of the *ASN1* Gene Enhances Nitrogen Status in Seeds of Arabidopsis", Plant Physiology, 2003, 132:926-935.
Jisheng Li et al., "*Arabidopsis* H$^+$ -PPase AVP1 Regulates Auxin-Mediated Organ Development", Science, 2005, 310: 121-125.
Anders M. Lindroth, et al., "Requirement of CHROMOMETHYLASE3 for Maintenance of CpXpG Methylation", Science, Jun. 2001, pp. 2077-2080, vol. 292, American Association for the Advancement of Science, Washington, DC.
Yoshiyuki Maruta et al., "Transgenic rice with reduced glutelin content by transformation with glutelin A antisense gene", Molecular Breeding, 2001, 8:273-284.
K. Diane Jofuku et al., "Control of seed mass and seed yield by the floral homeotic gene APETALA2", PNAS, 2005, 102(8): 3117-3122.
Kyoko Matsui, et al., "Bio Medical Quick Review Net ", 2004, pp. 1-6, vol. 4006.
Kyoko Matsui, et al., "Suppression of the biosynthesis of proanthocyanidin in *Arabidopsis* by a chimeric PAP1 repressor", Plant Biotechnology Journal, 2004, pp. 487-493, vol. 2, Blackwell Publishing Ltd.
Kyoko Matsui, "A Chimeric AtMYB23 Repressor Induces Hairy Roots, Elongation of Leaves and Stems, and Inhibition of the Deposition of Mucilage on Seed Coats in *Arabidopsis*", Plant Cell Physiology, 2005, pp. 147-155, vol. 46(1).
Akane Matsushita et al., "AGF1, an AT-Hook Protein, Is Necessary for the Negative Feedback of AtGA3ox1 Encoding GA 3-Oxidase", Plant Physiology, 2007, 143: 1152-1162.
Toshitsugu Nakano et al., "Genome-Wide Analysis of the ERF Gene Family in *Arabidopsis* and Rice", Plant Physiology, 2006, 140: 411-432.
Nobutaka Mitsuda et al., "Comprehensive functional analysis of plant-specific NAC transcription factor family using the CRES-T method", Abstracts of the 45th Annual Meeting of the Japanese Society of Plant Physiologists, Mar. 2004, P4-B-16 (813).

Zhongfu Ni et al., "Altered circadian rhythms regulate growth vigour in hybrids and allopolyploids", Nature, 2009, 457: 327-331.
Yukiko Mizukami et al., "Plant organ size control: AINTEGUMENTA regulates growth and cell numbers during organogenesis", PNAS, 2000, 97(2): 942-947.
Masaru Ohta, et al., "Repression Domains of Class II ERF Transcriptional Repressors Share and Essential Motif for Active Repression", The Plant Cell, Aug. 2001, pp. 1959-1968, vol. 13, American Society of Plant Biologists.
Ohto, 22nd International Conference on *Arabidopsis* Research, 2011, Pub: 501746623.
Akio Ohyama et al., "Environmental risk evaluation of rice plants transformed with chimeric antisense cDNA for glutelin", Breeding Research, 2001, 3: 139-149.
Y. Pan et al., "Molecular Cloning, Expression, Phylogenetic and Functional Characterization of the *Arabidopsis* AP2/EREBP Transcription Factor Family", Gen Bank Accession AY560877, 2004 retrieved from: http://www.ncbi.nlm.nih.gov/entrez/viewer.fcgi?48479345:NCBI:6713742 on Dec. 25, 2008.
"Represent" from Merriam-Webster Dictionary, Retrieved from http://www.merriam-webster.com/dictionary/represents on Feb. 5, 2013.
Diego Mauricio Riaño-Pachón et al., "Pln TFDB an integrative plant transcription factor database", BMC Bioinformatics, 2007, 8(42): 1-10.
Shinchiro Sawa, "Overexpression of the AtmybL2 Gene Represses Trichome Development in *Arabidopsis*", DNA Research, 2002, pp. 31-34, vol. 9, No. 2.
Marie C. Schruff et al., "The AUXIN Response Factor 2 gene of *Arabidopsis* links auxin signalling, cell division, and the size of seeds and other organs", Development, 2005, 133: 251-261.
Ralf Stracke et al., "The R2R3-MYB gene family in *Arabidopsis thaliana*", Current Opinion in Plant Biology, 2001, 4: 447-456.
Bo Shen et al., "The homeobox gene GLABRA2 affects seed oil content in *Arabidopsis*", Plant Molecular Biology, 2006, 60: 377-387.
S. Takada et al., Accession No. AB049071, The Cup-Shaped COYTLEDON1 gene of *Arabidopsis* regulates shoot apical meristem formation, Database NCBI/GenBank (online), 2006, retrieved from . http://www.ncbi.nlm.nih.gov/entrez/viewer.fcgi712060425:DDBJ:5636984 on Dec. 25, 2008.
Lu Tian et al., "Blocking histone deacetylation in *Arabidopsis* induces pleiotropic effects on plant gene regulation and development", PNAS, Jan. 2001, pp. 200-205, vol. 98, No. 1.
Geoffrey M. Wahl et al., "Molecular Hybridization of Immobilized Nucleic Acids: Theoretical Concepts and Practical Considerations", Methods in Enzymology, 1987, 152: 399-407.
Randall J. Weselake et al., "Increasing the flow of carbon into seed oil", Biotechnology Advances, 2009, 27: 866-878.
Joseph A. White et al., "Genomic approaches towards the engineering of oil seeds", Plant Physiology and Biochemistry, 2001, 39: 263-270.
K. Yamada et al., Accession No. BT005044, *Arabidopsis* Open Reading Frame (ORF) Clones, Database NCBI/GenBank (online), 2003, retrieved from . httD://www.ncbi.nlm.nih.jTOv/entrez/viewerfcgi?28827465:NCB1:4515668 on Dec. 25, 2008.
Chen Yanhui et al., "The MYB transcription factor superfamily of *Arabidopsis*: expression analysis and phylogenetic comparison with the rice MYB family", Plant Molecular Biology, 2006, 60(1): 107-124.
James Z. Zhang, "Overexpression Analysis of Plant Transcription Factors", Current Opinion in Plant Biology, 2003, 6: 430-440.
Gaiyun Zhang et al., Phylogeny, gene structures, and expression patterns of the ERF gene family in soybean (*Glycine max* L.), Journal of Experimental Botany, 2008, 59(15): 4095-4107.
Daniel Zilberman, et al., "ARGONAUTE4 Control of Locus-Specific siRNA Accumulation and DNA and Histone Methylation", Science, Jan. 2003, pp. 716-719, vol. 299, American Association for the Advancement of Science.
Restriction/Election of Species Requirement issued in U.S. Appl. No. 12/746,577, mailed on Aug. 16, 2013.
Non-Final Office Action issued in U.S. Appl. No. 12/746,577, mailed on Feb. 15, 2013.

(56) References Cited

OTHER PUBLICATIONS

Non-Final Office Action issued in U.S. Appl. No. 12/921,060, mailed on Feb. 19, 2013.
Notice to Comply issued in U.S. Appl. No. 12/746,640, mailed on Aug. 16, 2012.
Non-Final Office Action issued in U.S. Appl. No. 12/746,640, mailed on Nov. 27, 2012.
Final Office Action issued in U.S. Appl. No. 12/746,640, mailed on Jul. 2, 2013.
Notice of Allowance, dated Feb. 11, 2015, issued by the United States Patent and Trademark Office in U.S. Appl. No. 12/921,060.

* cited by examiner

GENE CAPABLE OF IMPROVING MATERIAL PRODUCTIVITY IN SEED AND METHOD FOR USE THEREOF

CROSS REFERENCE TO RELATED APPLICATIONS

This application is a National Stage of International Application No. PCT/JP2010/059543 filed Jun. 4, 2010, claiming priority based on Japanese Patent Application No. 2009-135321 filed Jun. 4, 2009, the contents of all of which are incorporated herein by reference in their entirety.

TECHNICAL FIELD

Background Art

Plants are cultivated for the purpose of using some tissues thereof (e.g., seeds, roots, leaves, or stems) or for the purpose of producing various substances (materials), such as fats and oils. Examples of fats and oils produced from plants that have been heretofore known include soybean oil, sesame oil, olive oil, coconut oil, rice oil, cottonseed oil, sunflower oil, corn oil, safflower oil, palm oil, and rapeseed oil. Such fats and oils are extensively used for household and industrial applications. Also, fats and oils produced from plants are used as raw materials for biodiesel fuel or bioplastic, and the applicability thereof is increasing for alternative energy to petroleum.

Under such circumstances, it is necessary to improve productivity per unit area of cultivated acreage in order to succeed in the industrial production of fats and oils using plants. Here, assuming that the number of cultivated plant individuals per unit area of cultivated acreage is stable, it can be understood that the fat and oil production per plant individual needs to be improved. When fats and oils are collected from seeds obtained from plants, it is expected that the fat and oil production per plant individual can be improved by techniques for improving the seed yield per plant individual, techniques for improving the fat and oil content in seeds, and similar techniques.

Techniques for improving the fat and oil production in plant seeds are roughly divided into the improvement of cultivation and the development of varieties with increased fat and oil productivity. Methods for developing varieties with increased fat and oil productivity are roughly divided into conventional breeding methods mainly involving crossing technology and molecular breeding methods comprising gene recombination. The following are known techniques for increasing fat and oil productivity via gene recombination: (A): a technique for modifying a system for synthesizing triacylglycerol (TAG) contained in seeds as a main component of plant fat and oil; and (B): a technique for modifying various regulatory genes that regulate plant morphogenesis or metabolism and expression of genes involved plant morphogenesis or metabolism.

Regarding technique (A), the following methods can be used as a method for increasing the amount of TAG synthesized using, as a starting material, a sugar produced via photosynthesis: (1): a method for increasing activity of synthesizing fatty acid or glycerol that is a constitutive component of TAG from a sugar; (2): a method for enhancing a reaction of synthesizing TAG from glycerol and fatty acid. In relation to the above technique, the following have been reported as gene engineering techniques. In one example of method (1), the fat and oil content in seeds was reportedly improved by 5% by causing *Arabidopsis thaliana* cytoplasm acetyl-coenzyme A carboxylase (ACCase) to be overexpressed in rapeseed plastids (Non-Patent Document 1). In one example of (2), a technique for increasing fat and oil productivity by causing overexpression of DGAT (diacylglycerol acyltransferase) capable of transferring an acyl group at the sn-3 position of diacylglycerol (Non-Patent Document 2) was reportedly developed. Regarding the technique of Non-Patent Document 2, fat and oil content and seed weight were reported to have increased with an increase in DGAT expression level, which might cause an increase in the number of seeds per plant individual. By the use of this method, the fat and oil content in seeds of *Arabidopsis thaliana* was found to have increased by 46%, and the fat and oil amount per plant individual was found to have increased by up to approximately 125%.

Meanwhile, one possible example of technique (B) is a method for regulating the expression of a transcription factor gene involved in the regulation of expression of a biosynthetic enzyme gene. Patent Document 1 discloses such method. According to the technique used in Patent Document 1, a recombinant plant in which a transcription factor is exhaustively overexpressed or knocked out is prepared, followed by selection of a gene that causes an increase in the fat and oil content in seeds. Patent Document 1 describes that the fat and oil content in seeds was found to have increased by 23% as a result of overexpression of the ERF subfamily B-4 transcription factor gene. However, Patent Document 1 does not describe an increase or decrease in the fat and oil content per plant individual. Non-Patent Document 3 describes that the fat and oil content in seeds can be improved by causing the overexpression of WRINKLED1, which is a transcription factor having an AP2/EREB domain.

Meanwhile, when a hydrocarbon component such as cellulose contained in a plant is glycosylated and then alcohol is produced via fermentation, it can be predicted that fat and oil components contained in a plant become impurities and thus cause reduction of glycosylation efficiency in the glycosylation step. Therefore, if the fat and oil content can be reduced, the glycosylation efficiency in the glycosylation step can be improved. As a result, improvement of alcohol productivity can be expected. For example, Non-Patent Document 3 discloses that seeds of a WRI1/ASML1 (AP2 family transcription factor; AGI-code:AT3g54320)-deficient strain become wrinkled, resulting in reduction of the fat and oil content. In addition, Patent Document 2 discloses that overexpression of AT3g23250 (MYB15) resulted in a 13% decrease in the fat and oil content in seeds, overexpression of AT1g04550 (IAA12) resulted in a 12% decrease in the same, and overexpression of AT1g66390 (MYB90) resulted in a 16% decrease in the same.

In spite of the development of the above molecular breeding methods for the improvement of a variety of traits, there are still no practically available techniques to increase or decrease fat and oil productivity.

As reasons for the above, it is considered that truly excellent genes remain undiscovered, and that new recombinant varieties that have been confirmed to have desirable effects in the test phase cannot exhibit expected effects upon practical use in differerent natural environments. In addition, a number of genes are involved in the expression of quantitative traits such as productivity of a desired material in different steps in the regulation system, the metabolizing system, and other systems. Thus, it has been difficult to discover or develop truly excellent and useful genes capable of improving quantitative traits. In order to solve such problems, an object of the present invention is to find a novel gene exhibiting remarkably high effects. Another object of the present invention is to develop a gene capable of exerting effects in a pracitcal environment to an extent comparable to the effects exereted in the test phase.

CITATION LIST

Patent Literature

Patent Document 1: WO01/36597
Patent Document 2: WO01/35727

Non-Patent Literature

Non-Patent Document 1: Plant Physiology (1997) Vol. 11, pp. 75-81
Non-Patent Document 2: Plant Physiology (2001), Vol. 126, pp. 861-874
Non-Patent Document 3: Plant J. (2004) 40, 575-585

SUMMARY OF INVENTION

Technical Problem

In view of the above circumstances, an object of the present invention is to provide a technique for searching for a gene having a novel function that can cause an increase or decrease in material productivity so as to improve such feature of a plant.

Solution to Problem

As a result of intensive studies to achive the above objects, the present inventors found that it is possible to improve various quantitative traits and particularly to increase or decrease material productivity via induction of expression of a chimeric protein obtained by fusing a particular transcription factor and a functional peptide capable of converting an arbitrary transcription factor into a transcriptional repressor (hereinafter sometimes referred to as a "repressor domain"). This has led to the completion of the present invention.

The plant of the present invention is obtained by inducing expression of a chimeric protein obtained by fusing a transcription factor consisting of any one of the following proteins (a) to (c) and a functional peptide capable of converting an arbitrary transcription factor into a transcriptional repressor.

(a) A protein comprising an amino acid sequence shown in any of the even-numbered SEQ ID NOS: 1 to 158.
(b) A protein having transactivation activity and comprising an amino acid sequence that has a deletion, a substitution, an addition, or an insertion of one or a plurality of amino acids with respect to an amino acid sequence shown in any of the even-numbered SEQ ID NOS: 1 to 158.
(c) A protein having transactivation activity encoded by a polynucleotide that hybridizes under stringent conditions to a polynucleotide consisting of a nucleotide sequence complementary to a nucleotide sequence shown in any of the odd-numbered SEQ ID NOS: 1 to 158.

Preferably, the fusion of a functional peptide with a predetermined transcription factor causes repression of transcriptional regulatory activity, and particularly, transactivation activity, of the transcription factor in the plant of the present invention. Examples of the above functional peptide used herein include peptides expressed by the following formulae (1) to (8).

(1) X1-Leu-Asp-Leu-X2-Leu-X3 (SEQ ID NO: 520 with deletion of 0-10 residues from the N-terminus (where X1 denotes a set of 0 to 10 amino acid residues, X2 denotes Asn or Glu, and X3 denotes a set of at least 6 amino acid residues.)

(2) Y1-Phe-Asp-Leu-Asn-Y2-Y3 (SEQ ID NO: 521 with deletion of 0-10 residues from the N-terminus (where Y1 denotes a set of 0 to 10 amino acid residues, Y2 denotes Phe or Ile, and Y3 denotes a set of at least 6 amino acid residues.)

(3) Z1-Asp-Leu-Z2-Leu-Arg-Leu-Z3 (SEQ ID NO: 522 with deletion of 0-10 residues from the C-terminus and deletion of 0-2 residues from the N-terminus)

(where Z1 denotes Leu, Asp-Leu, or Leu-Asp-Leu, Z2 denotes Glu, Gln, or Asp, and Z3 denotes a set of 0 to 10 amino acid residues.)

(4) Asp-Leu-Z4-Leu-Arg-Leu (residues 4-9 of SEQ ID NO: 522)

(where Z4 denotes Glu, Gln, or Asp.)

(5) α1-Leu-β1-Leu-γ1-Leu (SEQ ID NO: 523)
(6) α1-Leu-β1-Leu-γ2-Leu (SEQ ID NO: 524)
(7) α1-Leu-β2-Leu-Arg-Leu (SEQ ID NO: 525)
(8) α2-Leu-β1-Leu-Arg-Leu (SEQ ID NO: 526)

(where α1 denotes Asp, Asn, Glu, Gln, Thr, or Ser, α2 denotes Asn, Glu, Gln, Thr, or Ser, β1 denotes Asp, Gln, Asn, Arg, Glu, Thr, Ser, or His, β2 denotes Asn, Arg, Thr, Ser, or His, γ1 denotes Arg, Gln, Asn, Thr, Ser, His, Lys, or Asp, and γ2 denotes Gln, Asn, Thr, Ser, His, Lys, or Asp in formulae (5) to (8).)

In addition, the plant of the present invention is characeterized by significant improvement or reduction of material productivity per plant individual and particularly productivity of fat and oil contained in seeds. A specific tissue used in the present invention can be seed tissue. Here, the expression "significant improvement or reduction" indicates that the plant of the present invention allows an increase or decrease in the material productivity associated with a statistically significant difference when compared in terms of material productivity with a plant in which the above chimeric protein is not expressed.

Meanwhile, according to the present invention, the above chimeric protein, the gene encoding the chimeric protein, an expression vector comprising the gene, and a transformant comprising the gene can be provided.

This description includes part or all of the contents as disclosed in the description and/or drawings of Japanese Patent Application No. 2009-135321, which is a priority document of the present application.

Advantageous Effects of Invention

The material productivity per plant individual (and particularly the fat and oil content in seeds) is improved or reduced in the plant of the present invention. Therefore, the use of the plant of the present invention enables improvement of productivity of plant-derived fats and oils. Alternatively, for example, bioalcohol or the like can be produced with good efficiency using the plant of the present invention in which fats and oils contained as impurities can be reduced.

DESCRIPTION OF EMBODIMENTS

The present invention will be described in detail as follows.

The plant of the present invention is a plant in which a chimeric protein obtained by fusing a predetermined transcription factor and a functional peptide capable of converting an arbitrary transcription factor into a transcriptional repressor is expressed. The plant of the present invention is found to exhibit significant improvement or reduction of the material productivity per plant individual (and particularly the fat and oil content in seeds) when compared with a wild-type plant. Specifically, the plant of the present invention is produced by causing a transcription factor to be expressed in the form of a chimeric protein with the functional peptide in a desired plant so as to significantly improve or reduce the material productivity of the desired plant.

In particular, preferably, the transactivation activity of a transcription factor is repressed in the plant of the present invention by fusing the factor with the above functional peptide. In other words, when a chimeric protein obtained by fusing a transcription factor with the functional peptide is expressed in the plant of the present invention, this preferably results in expression of transcription repression effects originally imparted to the functional peptide as a dominant trait.

Here, the term "material productivity per plant individual" refers to the content of an individual substance (material) produced per unit volume of a plant. Such substance is not particularly limited. It may be a substance originally produced by a plant. Alternatively, it may be a substance that is not originally produced in a plant but can be produced in the plant via genetic engineering or the like.

In particular, if the content of a desired product per tissue increases, purification cost or transport cost can be reduced. Thus, such plant is highly industrially applicable. A particularly desired product may be lignocellulose, which accounts for the substantially total weight of a plant. It may be a plant oil industrially available as a seed oil. A plant oil may be composed of simple lipid in the form of ester of fatty acid and alcohol or of complex lipid containing phosphorus, sugar, nitrogen, and other components. It may be fatty acid itself. Examples of alcohol that can be used for simple lipid include higher alcohol with a large molecular weight and polyalcohol such as glycerol (glycerine). Examples of fatty acid that can be used for simple lipid include saturated fatty acid, unsaturated fatty acid, and specialty fatty acid containing a hydroxyl group or an epoxy group. Examples of simple lipid that can be used in the form of ester of glycerol and fatty acid include monoacylglycerol, diacylglycerol, and triacylglycerol.

Meanwhile, certain substances contained in plants becomes impurities depending on the use of the plants. Therefore, if productivity of such a certain substance in a plant decreases, the impurity content decreases. Such plant is highly industrially applicable. For example, in the case of glycosylation of lignocellulose contained in a plant, fat and oil components contained in the plant might become impurities and thus negatively influence glycosylation efficiency. Therefore, if the fat and oil productivity decreases, the efficiency of the glycosylation step in the process of producing bioalcohol or the like using a plant can be improved.

Fats and oils are described below as examples of target substances for productivity improvement or reduction. However, the technical scope of the present invention is not limited thereto. The present invention can be applied to substances other than fat and oil that are produced by plants.

Plants used herein are not particularly limited, and thus any plant can be used as a target plant. Particularly preferably, a plant conventioinally used for production of fat and oil is used. Examples of an available target plant include soybean, sesame, olive oil, coconut, rice, cotton, sunflower, corn, sugarcane, Jatropha, palm, tobacco, safflower, and rapeseed. Also, *Arabidopsis thaliana*, which has been widely used as an biological model for plant gene analysis and for which gene expression analysis methods have been established, can be used as a target plant.

In addition, transcription repression activity of a chimeric protein comprising a transcription factor is activity of recognizing a cis sequence that is recognized by the transcription factor or a cis sequence of a different transcription factor that is analogous to such a cis sequence so as to actively repress the expression of downstream genes. Thus, such chimeric protein can also be called a "transcriptional repressor." A method for causing a chimeric protein comprising a transcription factor to have transcription repression activity is not particularly limited. However, in particular, the most preferable method may be a method for constructing a chimeric protein (fusion protein) by adding a repressor domain sequence or an SRDX sequence thereto.

In the above method, as a repressor domain sequence, a variety of amino acid sequences discovered by the present inventors, each of which constitutes a peptide capable of converting an arbitrary transcription factor into a transcriptional repressor, can be used. For example, the following can be referred to for a method using a repressor domain sequence: JP Patent Publication (Kokai) No. 2001-269177 A; JP Patent Publication (Kokai) No. 2001-269178 A; JP Patent Publication (Kokai) No. 2001-292776 A; JP Patent Publication (Kokai) No. 2001-292777 A; JP Patent Publication (Kokai) No. 2001-269176 A; JP Patent Publication (Kokai) No. 2001-269179 A; WO03/055903; Ohta, M., Matsui, K., Hiratsu, K., Shinshi, H. and Ohme-Takagi, M., The Plant Cell, Vol. 13, 1959-1968, August, 2001; and Hiratsu, K., Ohta, M., Matsui, K., or Ohme-Takagi, M., FEBS Letters 514 (2002) 351-354. A repressor domain sequence can be excised from a Class II ERF (Ethylene Responsive Element Binding Factor) protein or a plant zinc finger protein (zinc finger protein such as *Arabidopsis thaliana* SUPERMAN protein). The sequence has a very simple structure.

Examples of a transcription factor constituting a chimeric protein to be expressed include transcription factors specified by AGI codes for *Arabidopsis thaliana* listed in tables 1 and 2. In addition, any transcription factor listed in table 1 causes a significant increase in fat and oil content in seeds when a chimeric protein comprising the transcription factor and a repressor domain is expressed in a plant. Meanwhile, any transcription factor listed in table 2 causes a significant decrease in fat and oil content in seeds when a chimeric protein comprising the transcription factor and a repressor domain is expressed in a plant.

TABLE 1

| AGI code | Nucleotide sequence | Amino acid sequence |
| --- | --- | --- |
| At5g47230 | SEQ ID NO: 1 | SEQ ID NO: 2 |
| At1g22985 | SEQ ID NO: 3 | SEQ ID NO: 4 |
| At1g80580 | SEQ ID NO: 5 | SEQ ID NO: 6 |
| At1g25470 | SEQ ID NO: 7 | SEQ ID NO: 8 |
| At1g67260 | SEQ ID NO: 9 | SEQ ID NO: 10 |
| At4g36160 | SEQ ID NO: 11 | SEQ ID NO: 12 |
| At5g64750 | SEQ ID NO: 13 | SEQ ID NO: 14 |
| At4g01550 | SEQ ID NO: 15 | SEQ ID NO: 16 |
| At1g24260 | SEQ ID NO: 17 | SEQ ID NO: 18 |
| At5g09330 | SEQ ID NO: 19 | SEQ ID NO: 20 |
| At2g31230 | SEQ ID NO: 21 | SEQ ID NO: 22 |

TABLE 2

| AGI code | Nucleotide sequence | Amino acid sequence |
| --- | --- | --- |
| At2g30470 | SEQ ID NO: 23 | SEQ ID NO: 24 |
| At2g17040 | SEQ ID NO: 25 | SEQ ID NO: 26 |
| At5g07690 | SEQ ID NO: 27 | SEQ ID NO: 28 |
| At3g15500 | SEQ ID NO: 29 | SEQ ID NO: 30 |
| At2g30420 | SEQ ID NO: 31 | SEQ ID NO: 32 |
| At3g09600 | SEQ ID NO: 33 | SEQ ID NO: 34 |
| At1g36060 | SEQ ID NO: 35 | SEQ ID NO: 36 |
| At1g01250 | SEQ ID NO: 37 | SEQ ID NO: 38 |
| At1g25580 | SEQ ID NO: 39 | SEQ ID NO: 40 |
| At3g20770 | SEQ ID NO: 41 | SEQ ID NO: 42 |

TABLE 2-continued

| AGI code | Nucleotide sequence | Amino acid sequence |
|---|---|---|
| At1g12890 | SEQ ID NO: 43 | SEQ ID NO: 44 |
| At2g18060 | SEQ ID NO: 45 | SEQ ID NO: 46 |
| At4g18390 | SEQ ID NO: 47 | SEQ ID NO: 48 |
| At5g08070 | SEQ ID NO: 49 | SEQ ID NO: 50 |
| At1g76580 | SEQ ID NO: 51 | SEQ ID NO: 52 |
| At4g28140 | SEQ ID NO: 53 | SEQ ID NO: 54 |
| At5g60970 | SEQ ID NO: 55 | SEQ ID NO: 56 |
| At2g42830 | SEQ ID NO: 57 | SEQ ID NO: 58 |
| At1g30210 | SEQ ID NO: 59 | SEQ ID NO: 60 |
| At1g71450 | SEQ ID NO: 61 | SEQ ID NO: 62 |
| At1g09540 | SEQ ID NO: 63 | SEQ ID NO: 64 |
| At3g10490 | SEQ ID NO: 65 | SEQ ID NO: 66 |
| At1g62700 | SEQ ID NO: 67 | SEQ ID NO: 68 |
| At1g49120 | SEQ ID NO: 69 | SEQ ID NO: 70 |
| At1g44830 | SEQ ID NO: 71 | SEQ ID NO: 72 |
| At1g30810 | SEQ ID NO: 73 | SEQ ID NO: 74 |
| At1g74840 | SEQ ID NO: 75 | SEQ ID NO: 76 |
| At5g18830 | SEQ ID NO: 77 | SEQ ID NO: 78 |
| At1g72360 | SEQ ID NO: 79 | SEQ ID NO: 80 |
| At1g32770 | SEQ ID NO: 81 | SEQ ID NO: 82 |
| At5g14000 | SEQ ID NO: 83 | SEQ ID NO: 84 |
| At2g23290 | SEQ ID NO: 85 | SEQ ID NO: 86 |
| At2g02450 | SEQ ID NO: 87 | SEQ ID NO: 88 |
| At1g27360 | SEQ ID NO: 89 | SEQ ID NO: 90 |
| At1g33760 | SEQ ID NO: 91 | SEQ ID NO: 92 |
| At3g27920 | SEQ ID NO: 93 | SEQ ID NO: 94 |
| At3g18550 | SEQ ID NO: 95 | SEQ ID NO: 96 |
| At1g52880 | SEQ ID NO: 97 | SEQ ID NO: 98 |
| At5g07310 | SEQ ID NO: 99 | SEQ ID NO: 100 |
| At4g26150 | SEQ ID NO: 101 | SEQ ID NO: 102 |
| At1g19490 | SEQ ID NO: 103 | SEQ ID NO: 104 |
| At1g52150 | SEQ ID NO: 105 | SEQ ID NO: 106 |
| At3g04060 | SEQ ID NO: 107 | SEQ ID NO: 108 |
| At4g32800 | SEQ ID NO: 109 | SEQ ID NO: 110 |
| At5g66300 | SEQ ID NO: 111 | SEQ ID NO: 112 |
| At5g13180 | SEQ ID NO: 113 | SEQ ID NO: 114 |
| At1g71692 | SEQ ID NO: 115 | SEQ ID NO: 116 |
| At1g27730 | SEQ ID NO: 117 | SEQ ID NO: 118 |
| At3g49850 | SEQ ID NO: 119 | SEQ ID NO: 120 |
| At3g02150 | SEQ ID NO: 121 | SEQ ID NO: 122 |
| At5g47220 | SEQ ID NO: 123 | SEQ ID NO: 124 |
| At5g43270 | SEQ ID NO: 125 | SEQ ID NO: 126 |
| At5g52020 | SEQ ID NO: 127 | SEQ ID NO: 128 |
| At1g69490 | SEQ ID NO: 129 | SEQ ID NO: 130 |
| At4g38620 | SEQ ID NO: 131 | SEQ ID NO: 132 |
| At2g45650 | SEQ ID NO: 133 | SEQ ID NO: 134 |
| At5g02460 | SEQ ID NO: 135 | SEQ ID NO: 136 |
| At1g12260 | SEQ ID NO: 137 | SEQ ID NO: 138 |
| At5g13330 | SEQ ID NO: 139 | SEQ ID NO: 140 |
| At4g01060 | SEQ ID NO: 141 | SEQ ID NO: 142 |
| At2g46590 | SEQ ID NO: 143 | SEQ ID NO: 144 |
| At1g69120 | SEQ ID NO: 145 | SEQ ID NO: 146 |
| At1g77450 | SEQ ID NO: 147 | SEQ ID NO: 148 |
| At2g23760 | SEQ ID NO: 149 | SEQ ID NO: 150 |
| At2g02070 | SEQ ID NO: 151 | SEQ ID NO: 152 |
| At1g22640 | SEQ ID NO: 153 | SEQ ID NO: 154 |
| At5g22380 | SEQ ID NO: 155 | SEQ ID NO: 156 |
| At5g62380 | SEQ ID NO: 157 | SEQ ID NO: 158 |

In addition, examples of a transcription factor constituting a chimeric protein are not limited to amino acid sequences (shown in the even-numbered SEQ ID NOS: 1 to 158) listed in tables 1 and 2. Also, it is possible to use a transcription factor having transactivation activity and comprising an amino acid sequence that has a deletion, a substitution, an addition, or an insertion of one or a plurality of amino acid sequences with respect to any of the amino acid sequences. Here, the term "a plurality of amino acids" refers to 1 to 20, preferably 1 to 10, more preferably 1 to 7, further preferably 1 to 5, and particularly preferably 1 to 3 amino acids, for example. In addition, amino acid deletion, substitution, or addition can be performed by modifying a nucleotide sequence encoding any of the above transcription factors by a technique known in the art. Mutation can be introduced into a nucleotide sequence by a known technique such as the Kunkel method or the Gapped duplex method or a method based thereon. For example, mutation is introduced with a mutagenesis kit using site-directed mutagenesis (e.g., Mutant-K or Mutant-G (both are trade names of Takara Bio)) or the like, or a LA PCR in vitro Mutagenesis series kit (trade name, Takara Bio). Also, a mutagenesis method may be: a method using a chemical mutation agent represented by EMS (ethyl methanesulfonate), 5-bromouracil, 2-aminopurine, hydroxylamine, N-methyl-N'-nitro-N nitrosoguanidine, or other carcinogenic compounds; or a method that involves radiation treatment or ultraviolet [UV] treatment typically using X-rays, alpha rays, beta rays, gamma rays, an ion beam, or the like.

Further, examples of a transcription factor constituting a chimeric protein are not limited to *Arabidopsis thaliana* transcription factors listed in tables 1 and 2. Examples of such transcription factor can include transcription factors that function in a similar manner in non-*Arabidopsis thaliana* plants (e.g., the aforementioned plants) (hereinafter referred to as homologous transcription factors). These homologous transcription factors can be searched for using the genomic information of a search target plant based on amino acid sequences listed in tables 1 and 2 or the nucleotide sequences of individual genes if the plant genomic information has been elucidated. Homologous transcription factors can be identified by searching for amino acid sequences having, for example, 70% or higer, preferably 80% or higher, more preferably 90% or higher, and most preferably 95% or higher homology to the amino acid sequences listed in tables 1 and 2. Here, the value of homology refers to a value that can be found based on default setting using a computer equipped with a BLAST algorithm and a database containing gene sequence information.

In addition, a homologous gene can be identified by, when the plant genome information remains unclarified, extracting the genome from a target plant or constructing a cDNA library for a target plant and then isolating a genomic region or cDNA hybridizing under stringent conditions to at least a portion of the gene encoding any one of the transcription factors listed in tables 1 and 2. Here, the term "stringent conditions" refers to conditions under which namely a specific hybrid is formed, but a non-specific hybrid is never formed. For example, such conditions comprise hybridization at 45° C. with 6×SSC (sodium chloride/sodium citrate), followed by washing at 50° C. to 65° C. with 0.2-1×SSC and 0.1% SDS. Alternatively, such conditions comprise hybridization at 65° C. to 70° C. with 1×SSC, followed by washing at 65° C. to 70° C. with 0.3× SSC. Hybridization can be performed by a conventionally known method such as a method described in J. Sambrook et al. Molecular Cloning, A Laboratory Manual, 2nd Ed., Cold Spring Harbor Laboratory (1989).

A feature of causing the fat and oil production in seeds to vary significantly (to be improved or reduced significantly) is imparted to the plant of the present invention by causing expression of the aforementioned chimeric protein comprising a transcription factor and a functional peptide in a plant. In particular, a feature of causing the fat and oil production in seeds to vary significantly (to be improved or reduced significantly) is imparted to the plant of the present invention by causing expression of a chimeric protein comprising a transcription factor of interest having repressed transactivation activity, further causing expression of transcription repression activity through recognition of a cis sequence homologous to a cis sequence recognized by the transcription factor of interest, or altering the specific affinity of the transcription factor of interest to that of another factor, nucleic acid, lipid, or carbohydrate. In the plant of the present invention, it is possible to create a chimeric protein by modifying an endogenous transcription factor. Alternatively, it is also possible to introduce a gene encoding a chimeric protein into the plant so as to cause the gene to be expressed therein.

For instance, it is preferable to use a method wherein a gene encoding a chimeric protein (fusion protein) obtained by fusing the aforementioned transcription factor and a functional peptide capable of converting an arbitrary transcription factor into a transcriptional repressor is introduced into a target plant to cause the chimeric protein (fusion protein) to be expressed in the plant.

The expression "transcription factor having repressed transactivation activity" used herein is not particularly limited. Such transcription factor has significantly lower transactivation activity than the original transcription factor. In addition, a "functional peptide capable of converting an arbitrary transcription factor into a transcriptional repressor" (sometimes referred to as a "transcription repressor converting peptide") is defined as a peptide having the function of causing an arbitrary transcription factor to have significantly lower transactivation activity than the original transcription factor when the peptide is fused with the transcription factor to create a chimeric protein. Such "functional peptide capable of converting an arbitrary transcription factor into a transcriptional repressor" is not particularly limited. However, it is particularly preferable for the functional peptide to consist of an amino acid sequence known as a repressor domain sequence or an SRDX sequence. Examples of such transcription repressor converting peptide are described in detail in JP Patent Publication (Kokai) No. 2005-204657 A. Any example disclosed in such document can be used.

For example, a transcription repressor converting peptide consists of an amino acid sequence expressed by any one of the following formulae (1) to (8).

(1) X1-Leu-Asp-Leu-X2-Leu-X3 (SEQ ID NO: 520 with deletion of 0-10 residues from the N-terminus (where X1 denotes a set of 0 to 10 amino acid residues, X2 denotes Asn or Glu, and X3 denotes a set of at least 6 amino acid residues.)

(2) Y1-Phe-Asp-Leu-Asn-Y2-Y3 (SEQ ID NO: 521 with deletion of 0-10 residues from the N-terminus (where Y1 denotes a set of 0 to 10 amino acid residues, Y2 denotes Phe or Ile, and Y3 denotes a set of at least 6 amino acid residues.)

(3) Z1-Asp-Leu-Z2-Leu-Arg-Leu-Z3 (SEQ ID NO: 522 with deletion of 0-10 residues from the C-terminus and deletion of 0-2 residues from the N-terminus)

(where Z1 denotes Leu, Asp-Leu, or Leu-Asp-Leu, Z2 denotes Glu, Gln, or Asp, and Z3 denotes a set of 0 to 10 amino acid residues.)

(4) Asp-Leu-Z4-Leu-Arg-Leu (residues 4-9 of SEQ ID NO: 522)

(where Z4 denotes Glu, Gln, or Asp.)

(5) α1-Leu-β1-Leu-γ1-Leu (SEQ ID NO: 523)

(6) α1-Leu-β1-Leu-γ2-Leu (SEQ ID NO: 524)

(7) α1-Leu-β2-Leu-Arg-Leu (SEQ ID NO: 525)

(8) α2-Leu-β1-Leu-Arg-Leu (SEQ ID NO: 526)

(where α1 denotes Asp, Asn, Glu, Gln, Thr, or Ser, α2 denotes Asn, Glu, Gln, Thr, or Ser, β1 denotes Asp, Gln, Asn, Arg, Glu, Thr, Ser, or His, β2 denotes Asn, Arg, Thr, Ser, or His, γ1 denotes Arg, Gln, Asn, Thr, Ser, His, Lys, or Asp, and γ2 denotes Gln, Asn, Thr, Ser, His, Lys, or Asp in formulae (5) to (8).)

Transcription repressor converting peptide of formula (1)

The number of amino acid residues in the set denoted by "X1" may be 0 to 10 for the transcription repressor converting peptide of formula (1). In addition, types of specific amino acids corresponding to amino acid residues in the set denoted by X1 are not particularly limited. Any amino acid can be used. In view of ease of synthesis of the transcription repressor converting peptide of formula (1), it is preferable to minimize the length of the set of amino acid residues denoted by X1. Specifically, the number of amino acid residues in the set denoted by X1 is preferably not more than 5.

Similarly, the number of amino acid residues in the set denoted by X3 may be at least 6 for the transcription repressor converting peptide of formula (1). In addition, types of specific amino acids corresponding to amino acid residues in the set denoted by X3 are not particularly limited, and thus any amino acid may be used.

Transcription Repressor Converting Peptide of Formula (2)

As in the case of X1 for the transcription repressor converting peptide of formula (1), the number of amino acid residues in the set denoted by Y1 for the transcription repressor converting peptide of formula (2) may be 0 to 10. In addition, types of specific amino acids corresponding to amino acid residues in the set denoted by Y1 are not particularly limited, and thus any amino acid may be used. The number of specific amino acid residues in the set denoted by Y1 is preferably not more than 5.

Similarly, as in the case of X3 for the transcription repressor converting peptide of formula (1), the number of amino acid residues in the set denoted by Y3 for the transcription repressor converting peptide of formula (2) may be at least 6. In addition, types of specific amino acids corresponding to amino acid residues in the set denoted by Y3 are not particularly limited, and thus any amino acid may be used.

Transcription Repressor Converting Peptide of Formula (3)

For the transcription repressor converting peptide of formula (3), the set of amino acid residues denoted by Z1 contains 1 to 3 "Leu" amio acids. When it contains a single amino acid, Z1 denotes Leu. When it contains two amino acids, Z1 denotes Asp-Leu. When it contains 3 amino acids, Z1 denotes Leu-Asp-Leu.

Meanwhile, for the transcription repressor converting peptide of formula (3), the number of amino acid residues in the set denoted by Z3 may be 0 to 10. In addition, types of specific amino acids corresponding to amino acid residues in the set denoted by Z3 are not particularly limited, and thus any amino acid may be used. Specifically, the number of amino acid residues in the set denoted by Z3 is preferably not more than 5. Specific examples of an amino acid residue in the set denoted by Z3 include, but are not limited to, Gly, Gly-Phe-Phe, Gly-Phe-Ala, Gly-Tyr-Tyr, and Ala-Ala-Ala.

In addition, the number of amino acid residues consisting of a transcription repressor converting peptide as a whole of formula (3) is not particularly limited. However, in view of ease of synthesis, it is preferably not more than 20 amino acids.

Transcription Repressor Converting Peptide of Formula (4)

The transcription repressor converting peptide of formula (4) is a hexamer (6mer) consisting of 6 amino acid residues. In addition, if the amino acid residue denoted by Z4 in the transcription repressor converting peptide of formula (4) is Glu, the amino acid sequence of the peptide corresponds to a region ranging from position 196 to position 201 of the amino acid sequence of the *Arabidopsis thaliana* SUPERMAN protein (SUP protein).

A chimeric protein (fusion protein) is created through fusion of any of the different transcription repressor converting peptides described above and any of the transcription factors described above so as to modify characteristics of the transcription factor. Specifically, a chimeric protein (fusion protein) is created through fusion of the transcription factor and the transcription repressor converting peptide, making it possible to modify the transcription factor into a transcriptional repressor or a negative transcriptional coactivator. In addition, it is possible to further convert a non-dominant transcriptional repressor into a dominant transcriptional repressor.

In addition, a chimeric protein (fusion protein) can be produced by obtaining a fusion gene of a polynucleotide encoding any transcription repressor converting peptide described above and a gene encoding a transcription factor. Specifically, a fusion gene is constructed by linking a polynucleotide encoding the transcription repressor converting peptide (hereinafter refferred to as a "transcription repressor converting polynucleotide") and the gene encoding a transcription factor. The fusion gene is introduced into plant cells, thereby allowing production of a chimeric protein (fusion protein). The specific nucleotide sequence of the transcription repressor converting polynucleotide is not particularly limited. It is only necessary for the transcription repressor converting polynucleotide to comprise a nucleotide sequence corresponding to the amino acid sequence of the transcription repressor converting peptide in accordance with the genetic code of the peptide. In addition, if necessary, the transcription repressor converting polynucleotide may have a nucleotide sequence that serves as a linking site via which the transcription repressor converting polynucleotide is linked to a transcription factor gene. Further, if the amino acid reading frame of the transcription repressor converting polynucleotide does not match the reading frame of the transcription factor gene, the transcription repressor converting polynucleotide can comprise an additional nucleotide sequence that allows matching of both reading frames. Furthermore, the transcription repressor converting polynucleotide may comprise a variety of additional polypeptides such as a polypeptide having a linker function to link a transcription factor and a transcription repressor converting peptide and a polypeptide such as His, Myc, or Flag used for epitope labeling of a chimeric protein (fusion protein). Moreover, if necessary, the chimeric protein (fusion protein) may have a construct such as a sugar chain, an isoprenoid group, or the like as well as such polypeptide.

A method for producing a plant is not particularly limited as long as it comprises a step of producing the above chimeric protein comprising a transcription factor and a transcription repressor converting peptide in a plant. However, for example, a production method comprising steps such as an expression vector construction step, a transformation step, and a selection step can be used. Each step is specifically described below.

Expression Vector Construction Step

The expression vector construction step is not particularly limited as long as it includes a step of constructing a recombinant expression vector containing the gene encoding a transcription factor, a transcription repressor converting polynucleotide, and a promoter. As a vector serving as a mother body for a recombinant expression vector, various conventionally known vectors can be used. For example, plasmids, phages, cosmids, or the like can be used and such vector can be appropriately selected depending on plant cells into which it is introduced and introduction methods. Specific examples of such vector include pBR322, pBR325, pUC19, pUC119, pBluescript, pBluescriptSK, and pBI vectors. Particularly, when a method for introduction of a vector into a plant uses *Agrobacterium*, a pBI binary vector is preferably used. Specific examples of such pBI binary vector include pBIG, pBIN19, pBI101, pBI121, and pBI221.

A promoter used herein is not particularly limited as long as it can cause gene expression in plants. Any known promoter can be appropriately used. Examples of such promoter include a cauliflower mosaic virus 35S promoter (CaMV35S), various actin gene promoters, various ubiquitin gene promoters, a nopaline synthase gene promoter, a tobacco PR1a gene promoter, a tomato ribulose1,5-bisphosphate carboxylase-oxidase small subunit gene promoter, a napin gene promoter, and an oleosin gene promoter. Of these, a cauliflower mosaic virus 35S promoter, an actin gene promoter, or a ubiquitin gene promoter can be more preferably used. The use of each of the above promoters enables strong expression of any gene when it is introduced into plant cells. The specific structure of a recombinant expression vector itself is not particularly limited as long as the promoter is linked to a fusion gene obtained by linking a gene encoding a transcription factor or a transcriptional coactivator and a transcription repressor converting polynucleotide so as to cause expression of the gene and introduced into the vector.

In addition, a recombinant expression vector may further contain other DNA segments, in addition to a promoter and the fusion gene. Such other DNA segments are not particularly limited and examples thereof include a terminator, a selection marker, an enhancer, and a nucleotide sequence for enhancing translation efficiency. Also, the above recombinant expression vector may further have a T-DNA region. A T-DNA region can enhance efficiency for gene introduction particularly when the above recombinant expression vector is introduced into a plant using *Agrobacterium*.

A transcription terminator is not particularly limited as long as it has functions as a transcription termination site and may be any known transcription terminator. For example, specifically, a transcription termination region (Nos terminator) of a nopaline synthase gene, a transcription termination region (CaMV35S terminator) of cauliflower mosaic virus 35S, or the like can be preferably used. Of them, the Nos terminator can be more preferably used. In the case of the above recombinant vector, a phenomenon such that an unnecessarily long transcript is synthesized and that a strong promoter decreases the number of copies of a plasmid after introduction into plant cells can be prevented by arranging a transcription terminator at an appropriate position.

As a transformant selection marker, a drug resistance gene can be used, for example. Specific examples of such drug resistance gene include drug resistance genes against hygromycin, bleomycin, kanamycin, gentamicin, chloramphenicol, and the like. Transformed plants can be easily selected by selecting plants that can grow in medium containing the above antibiotics.

An example of a nucleotide sequence for increasing translation efficiency is an omega sequence from tobacco mosaic virus. This omega sequence is arranged in an untranslated region (5'UTR) of a promoter, so that the translation efficiency of the fusion gene can be increased. As such, the recombinant expression vector can contain various DNA segments depending on purposes.

A method for constructing a recombinant expression vector is not particularly limited. To an appropriately selected vector serving as a mother body, the above promoter, a gene encoding a transcription factor, a transcription repressor converting polynucleotide, and, if necessary, the above other DNA segments may be introduced in a predetermined order. For example, a gene encoding a transcription factor and a transcription repressor converting polynucleotide are linked to construct a fusion gene, and then the fusion gene and the promoter (e.g., a transcription terminator according to need)

are then linked to construct an expression cassette and then the cassette may be introduced into a vector.

In construction of a chimeric gene (fusion gene) and an expression cassette, for example, cleavage sites of DNA segments are prepared to have protruding ends complementary to each other and then performing a reaction with a ligation enzyme, making it possible to specify the order of the DNA segments. In addition, when an expression cassette contains a terminator, DNA segments may be arranged in the following order from upstream: a promoter, the chimeric gene, and a terminator. Also, reagents for construction of an expression vector (that is, types of restriction enzymes, ligation enzymes, and the like) are also not particularly limited. Hence, commercially available reagents can be appropriately selected and used.

Also, a method for replicating (a method for producing) the above expression vector is not particularly limited and conventionally known replication methods can be used herein. In general, such expression vector may be replicated within *Escherichia coli* as a host. At this time, preferred types of *Escherichia coli* may be selected depending on the types of vector.

Transformation Step

The transformation step carried out in the present invention is a step of introducing the fusion gene into plant cells using the above recombinant expression vector so as to cause the expression of the gene. A method for introducing such gene into plant cells (transformation method) using a recombinant expression vector is not particularly limited. Conventionally known appropriate introduction methods can be used depending on plant cells. Specifically, a method using *Agrobacterium* or a method that involves direct introduction into plant cells can be used, for example. As a method using *Agrobacterium*, a method described in the following can be employed, for example: Bechtold, E., Ellis, J. and Pelletier, G. (1993), In Planta *Agrobacterium*-mediated gene transfer by infiltration of adult *Arabidopsis* plants. C. R. Acad. Sci. Paris Sci. Vie, 316, 1194-1199; or Zyprian E, Kado Cl, *Agrobacterium*-mediated plant transformation by novel mini-T vectors in conjunction with a high-copy vir region helper plasmid, Plant Molecular Biology, 1990, 15(2), 245-256.

As a method for directly introducing DNA comprising a recombinant expression vector and a target gene into plant cells, microinjection, electroporation, a polyethylene glycol method, a particle gun method, protoplast fusion, a calcium phosphate method, or the like can be employed.

Also, when a method for directly introducing DNA into plant cells is employed, DNA that can be used herein contains transcriptional units required for the expression of a target gene, such as a promoter and a transcription terminator, and a target gene. Vector functions are not essential in such case. Moreover, a DNA that contains a protein coding region alone of a target gene having no transcriptional unit may be used herein, as long as it is integrated into a host's transcriptional unit and then the target gene can be expressed.

Examples of plant cells into which DNA comprising the above recombinant expression vector and a target gene or DNA containing no expression vector but a target gene DNA is introduced include cells of each tissue of plant organs such as flowers, leaves, and roots, calluses, and suspension-cultured cells. At this time, according to the plant production method of the present invention, an appropriate expression vector may be constructed as the above recombinant expression vector according to the type of plant to be produced or a versatile expression vector may be constructed in advance and then introduced into plant cells. That is to say, the plant production method of the present invention may or may not comprise a step of constructing a DNA for transformation using the recombinant expression vector.

Other Steps and Methods

The plant production method of the present invention needs to comprise at least the transformation step, and the method may further comprise a step of constructing the DNA for transformation using the recombinant expression vector. The method may further comprise other steps. Specifically, for example, a step of selecting an appropriate transformant from among transformed plants can be employed.

A selection method is not particularly limited. For example, selection may be carried based on drug resistance such as hygromycin resistance. Alternatively, selection may be carried out based on the fat and oil content in seeds collected from cultivated transformants (plants). For example, a method comprising collecting plant seeds, determining the fat and oil content in the seeds according to a standard method, and comparing the fat and oil content with the fat and oil content in non-transformed plant seeds can be employed in a case in which selection is carrried out based on the fat and oil content (see the Examples described below).

According to the plant production method of the present invention, the fusion gene is introduced into a plant. This makes it possible to obtain an offspring plant having a significantly improved fat and oil content in comparison with the plant via sexual reproduction or asexual reproduction. Also, plant cells or reproductive materials, such as seeds, fruits, stocks, calluses, tubers, cut ears, or lumps, may be obtained from the plant or an offspring plant thereof. The plant can be mass-produced therefrom based on such materials. Therefore, the plant production method of the present invention may comprise a reproduction step (mass production step) for reproducing a selected plant.

In addition, the plant of the present invention may include a matter comprising at least any one of an adult plant, plant cells, plant tissue, callus, and seeds. That is, according to the present invention, any matter in a state that allows it to eventually grow to become a plant can be regarded as a plant. In addition, plant cells include plant cells in various forms. Examples of such plant cells include suspension-cultured cells, protoplasts, and leaf sections. As a result of proliferation/differentiation of such plant cells, a plant can be obtained. In addition, a plant can be reproduced from plant cells by a conventionally known method depending on the types of plant cells. Therefore, the plant production method of the present invention may comprise a regeneration step of regenerating a plant from plant cells or the like.

In addition, the plant production method of the present invention is not limited to a method of transformation using a recombinant expression vector. A different method may be used. Specifically, for example, the chimeric protein (fusion protein) itself can be administered to a plant. In this case, the chimeric protein (fusion protein) can be administered to a young plant such that the fat and oil content can be improved at a part of a plant that is eventually used. In addition, a method of administration of a chimeric protein (fusion protein) is not particularly limited, and a different known method can be used.

As described above, according to the present invention, it becomes possible to provide a plant for which the material productivity has been caused to vary (to be improved or reduced) relative to the material productivity of a wild-type plant by inducing expression of a chimeric protein comprising a predetermined transcription factor and any functional peptide described above. When the chimeric protein is expressed in a plant, it might cause reppression of transactivation activity of a target transcription factor or it might cause exhibition of transcription repression effects upon a sequence homologous to a cis sequence recognized by a target transcription factor. Further, in some cases, such chimeric protein functions to change the specific affinity of another factor, DNA, RNA, lipid, or carbohydrate having affinity to a target transcription factor or transcriptional coactivator. Alternatively, in some cases, it functions to cause a substance having no affinity to a target transcription factor to have improved affinity thereto. The following factors can be expressed in a similar manner in the plant of the present invention: a transcription factor that constitutes a chimeric protein; a transcription factor capable of recognizing a cis sequence homologous to a cis sequence recognized by the transcription factor; a transcription factor homologous to a transcription factor that constitutes a chimeric protein; other factors each having affinity to a transcription factor that constitutes a chimeric protein; and the like. However, the above effects of a chimeric protein allow suppression of gene expression to be controlled in a dominant-negative manner. Accordingly, the expression levels of gene groups involved in plant growth and the expression levels of gene groups involved in fat and oil production in seeds and/or gene groups involved in decomposition of produced fats and oils would vary in the plant of the present invention. This is thought to cause significant variation in fat and oil content.

Here, significant variation in the fat and oil content exists in a case in which the plant of the present invention exhibits an improvement of fat and oil content over a wild-type plant while the single seed mass remains stable, a case in which the plant of the present invention is found to exhibit improvement of fat and oil content with a significantly higher or lower level of single seed mass than that of a wild-type plant, or a case in which the plant of the present invention is found to exhibit improvement or reduction of fat and oil content in seeds when compared with a wild-type plant. In any case, it corresponds to a variation in the content of fat and oil produced by a single individual plant.

More specifically, if a chimeric protein comprising any transcription factor listed in table 1 is expressed in a plant, the fat and oil content in the plant would be improved. Among the plants of the present invention, a plant confirmed to have increased fat and oil content can be used for a method for producing plant-derived fats and oils. For example, fat and oil can be produced by cultivating the plant of the present invention, taking seeds therefrom, and collecting fat and oil components from the obtained seeds. In particular, it can be said that the fat and oil production method using the plant of the present invention is a method whereby high fat and oil content in a single plant indivival can be achieved, resulting in excellent productivity. In other words, assuming that the number of cultivated plant individuals per unit area of cultivated acreage is stable, the amount of fat and oil produced per unit area of cultivated acreage can be remarkabley improved with the use of the plant of the present invention. Therefore, cost necessary for fat and oil production can be significantly reduced with the use of the plant of the present invention.

Further, it can be said that the method for producing fat and oil using a plant of the present invention is a method excellent in terms of productivity. This is because high fat and oil contents per unit weight can be achieved thereby. In addition, fats and oils produced by the method for producing fat and oil using a plant of the present invention are not particularly limited. Examples of such fats and oils include plant-derived fats and oils such as soybean oil, sesame oil, olive oil, coconut oil, rice oil, cottonseed oil, sunflower oil, corn oil, safflower oil, and rapeseed oil. In addition, produced fat and oil can be extensively used for household and industrial applications.

Also, such fat and oil can be used as raw materials for biodiesel fuel. That is, the above fats and oils used for household and industrial applications, biodiesel fuel, and the like can be produced at low cost with the use of the plant of the present invention.

Meanwhile, when a chimeric protein comprising any transcription factor listed in table 2 is expressed in a plant, the fat and oil content in the plant decreases. The plant of the present invention in which the fat and oil content is reduced can be used for a method for producing bioalcohol using lignocellulose contained in plants. That is, bioalcohol can be produced with excellent glycosylation efficiency and low impurity contents because the contents of fat and oil components that become impurities in a step of glycosylation of lignocellulose are low in such plant.

Concerning At5g22380

As described above, when a chimeric protein comprising a repressor domain and any transcription factor listed in table 1 is expressed in a plant, the fat and oil content in seeds is significantly improved. When a chimeric protein comprising a repressor domain and any transcription factor listed in table 2 is expressed in a plant, the fat and oil content in seeds is significantly reduced. Therefore, if any transcription factor listed in table 1 that is originally not fused with a repressor domain is introduced as is into a plant, it is highly probable that the fat and oil content in seeds will be significantly reduced. In addition, if any transcription factor listed in table 2 that is originally not fused with a repressor domain is introduced as is into a plant, it is highly probable that the fat and oil content in seeds will be significantly improved. Here, each transcription factor can be obtained by techniques described in the above paragraphs about "the expression vector construction step," "the transformation step," and "the other step or method."

In particular, as demonstrated in the Examples below, when a chimeric protein comprising At5g22380, which is one of the transcription factors listed in table 2, and a repressor domain is expressed in a plant, the fat and oil content in seeds is significantly reduced. However, when At5g22380 (used as a transcription factor that is originally not fused with a repressor domain in a plant) is expressed as is in a plant, it exhibits a characteristic feature of causing the fat and oil content in seeds to be significantly improved. That is, productivity of fat and oil in seeds can be improved by causing At5g22380 to be expressed in a plant as an *Arabidopsis-thaliana*-derived transcription factor.

In order to cause a transcription factor (At5g22380) to be expressed in a plant, techniques described in the above paragraphs about "the expression vector construction step," "the transformation step," and "the other step or method" can be employed. In addition, a transcription factor that is expressed to improve the fat and oil content in seeds is not limited to an *Arabidopsis-thaliana*-derived transcription factor (At5g22380). It may be a homologous transcription factor defined as above. These homologous transcription factors can be searched for using the genomic information of a search target plant based on the amino acid sequence of At5g22380 shown in SEQ ID NO: 156 or the nucleotide sequence of the At5g22380 gene shown in SEQ ID NO: 155. Homologous transcription factors can be identified by searching for amino acid sequences having, for example, 70% or higer, preferably 80% or higher, more preferably 90% or higher, and most preferably 95% or higher homology to the amino acid sequence shown in SEQ ID NO:156. Here, the value of homology refers to a value that can be found based on default setting using a computer equipped with a BLAST algorithm and a database containing gene sequence information.

In addition, a homologous gene can be identified by, when the plant genome information remains unclarified, extracting the genome from a target plant or constructing a cDNA library for a target plant and then isolating a genomic region or cDNA hybridizing under stringent conditions to at least a portion of the gene comprising the nucleotide sequence shown in SEQ ID NO: 155. Here, the term "stringent conditions" is defined as the same as the above conditions.

EXAMPLE

The present invention is hereafter described in greater detail with reference to the following examples, although the technical scope of the present invention is not limited thereto.

Example 1

Transcription Factor Gene Amplification

Each of the following transcription factors was subjected to PCR amplification of a coding region DNA fragment excluding a termination codon using the *Arabidopsis thaliana* cDNA library and primers described below: At1g01010, At1g01250, At1g09540, At1g10200, At1g12260, At1g12890, At1g12980, At1g14510, At1g15360, At1g17520, At1g18330, At1g18570, At1g19490, At1g22640, At1g22985, At1g24260, At1g24590, At1g25470, At1g25580, At1g27360, At1g27370, At1g27730, At1g28160, At1g28520, At1g30210, At1g30810, At1g32770, At1g33760, At1g34190, At1g36060, At1g43160, At1g43640, At1g44830, At1g49120, At1g52150, At1g52880, At1g52890, At1g53230, At1g56010, At1g56650, At1g60240, At1g61110, At1g62700, At1g63040, At1g63910, At1g64380, At1g67260, At1g67780, At1g68800, At1g69120, At1g69490, At1g71030, At1g71450, At1g71692, At1g72360, At1g72570, At1g74840, At1g74930, At1g76580, At1g77200, At1g77450, At1g78080, At1g79180, At1g80580, At2g02070, At2g02450, At2g17040, At2g18060, At2g22200, At2g23290, At2g23760, At2g26060, At2g28550, At2g30420, At2g30470, At2g31230, At2g33480, At2g33710, At2g35700, At2g40220, At2g41710, At2g42400, At2g42830, At2g44840, At2g44940, At2g45650, At2g45680, At2g46310, At2g46590, At2g47520, At3g01530, At3g02150, At3g02310, At3g04060, At3g04070, At3g04420, At3g05760, At3g09600, At3g10490, At3g11280, At3g14230, At3g15500, At3g15510, At3g18550, At3g20770, At3g23220, At3g23230, At3g23240, At3g25890, At3g27920, At3g28910, At3g29035, At3g45150, At3g49850, At3g54320, At3g61910, At4g01060, At4g01550, At4g18390, At4g18450, At4g23750, At4g26150, At4g27950, At4g28140, At4g28530, At4g31060, At4g31270, At4g32800, At4g34410, At4g35580, At4g36160, At4g37750, At4g38620, At4g39780, At5g02460, At5g06100, At5g07310, At5g07580, At5g07680, At5g07690, At5g08070, At5g08790, At5g09330, At5g13180, At5g13330, At5g13910, At5g14000, At5g18270, At5g18560, At5g18830, At5g22290, At5g22380, At5g23260, At5g24520, At5g24590, At5g25190, At5g25390, At5g25810, At5g35550, At5g39610, At5g40330, At5g41030, At5g43270, At5g47220, At5g47230, At5g47390, At5g51190, At5g52020, At5g53290, At5g54230, At5g58900, At5g60970, At5g61600, At5g62380, At5g64530, At5g64750, At5g66300, At5g67000, At5g67300 and At5g67580. Note that a DNA fragment of a region including a termination codon was amplified for At5g22380. PCR was carried out under conditions of 94° C. for 1 minute, 47° C. for 2 minutes, and elongation reaction at 74° C. for 1 minute for 25 cycles. Next, each PCR product was isolated by agarose gel electrophoresis and collected.

TABLE 3

| AGI code | Fowerd primer | Nucleotide sequence | Reverse primer | Nucleotide sequence |
|---|---|---|---|---|
| At1g01010 | GATGGAGGATCAAGTTGGGTTTGGG | SEQ ID NO: 159 | ACCAACAAGAATGATCCAACTAATG | SEQ ID NO: 160 |
| At1g01250 | ATGTCACCACAGAGAATGAAGC | SEQ ID NO: 161 | CAGACACGCCATGAACTGATAC | SEQ ID NO: 162 |
| At1g09540 | GATGGGGAGACATTCTTGCTGTTACAAACA | SEQ ID NO: 163 | AAGGGACTGACCAAAAGAGACGGCCATTCT | SEQ ID NO: 164 |
| At1g10200 | GGGATGGCGTTCGCAGGAACAACCCAGAAATG | SEQ ID NO: 165 | AGCAGCGACGACTTTGTCCTTGGCG | SEQ ID NO: 166 |
| At1g12260 | GATGAATTCATTTTCCCACGTCCCTCCGCG | SEQ ID NO: 167 | CTTCCATAGATCAATCTGACAACTCGAAGA | SEQ ID NO: 168 |
| At1g12890 | ATGTTGAAATCAAGTAACAAGAG | SEQ ID NO: 169 | CATAAGAAACTGTGGAGCATC | SEQ ID NO: 170 |
| At1g12980 | AATGGAAAAAGCCTTGAGAAACTTC | SEQ ID NO: 171 | TCCCCACGATCTTCGGCAAGTACA | SEQ ID NO: 172 |
| At1g14510 | ATGGAAGGAATTCAGCATCC | SEQ ID NO: 173 | GGCTTTCATTTTCTTGCTGG | SEQ ID NO: 174 |
| At1g15360 | ATGGTACAGACGAAGAAGTTCAG | SEQ ID NO: 175 | GTTTGTATTGAGAAGCTCCTCTATC | SEQ ID NO: 176 |
| At1g17520 | GATGGGAAATCAGAAGCTCAAATGGACGGC | SEQ ID NO: 177 | ATTCAAGTACATAATCTTTCCCTGACTACA | SEQ ID NO: 178 |
| At1g18330 | GATGGCCGCTGAGGATCGAAGTGAGGAACT | SEQ ID NO: 179 | GCATATACGTGCTCTTTGGCTTTTCTTTTC | SEQ ID NO: 180 |
| At1g18570 | GATGGTGCGGACACCGTGTTGCAAAGCTGA | SEQ ID NO: 181 | TCCAAAATAGTTATCAATTTCGTCAAACAA | SEQ ID NO: 182 |
| At1g19490 | GATGGAGTTGGAGCCTATATCATCGAGTTG | SEQ ID NO: 183 | TCCGACCTGCATCCGACATTGACGCCCATG | SEQ ID NO: 184 |
| At1g22640 | GATGGGAAGATCACCATGCTGCGAGAAAGC | SEQ ID NO: 185 | ATGAGTTCTAACATCAGAAACCCGACAATT | SEQ ID NO: 186 |
| At1g22985 | ATGAAACGAATTGTTCGAATTTCATTC | SEQ ID NO: 187 | AACAACTTCTTCAGAAGCACCAC | SEQ ID NO: 188 |

TABLE 3-continued

| AGI code | Foward primer | Nucleotide sequence | Reverse primer | Nucleotide sequence |
|---|---|---|---|---|
| At1g24260 | GATGGGAAGAGGGAGAGTAGAATTGAAGAG | SEQ ID NO: 189 | AATAGAGTTGGTGTCATAAGGTAACCAACC | SEQ ID NO: 190 |
| At1g24590 | ATGGAAGAAGCAATCATGAGAC | SEQ ID NO: 191 | ATAATCATCATGAAAGCAATACTG | SEQ ID NO: 192 |
| At1g25470 | ATGTCGGCTGTGTCTGAATCG | SEQ ID NO: 193 | AACCAAACCGAGAGGCGGTG | SEQ ID NO: 194 |
| At1g25580 | GATGGCTGGGCGATCATGGCTGATC | SEQ ID NO: 195 | CAGCAGCGTGGCAGTGTGTTGCC | SEQ ID NO: 196 |
| At1g27360 | GATGGACTGCAACATGGTATCTTCGTCCCA | SEQ ID NO: 197 | TTTTGGTACAACATCATATGAACAGAGTAG | SEQ ID NO: 198 |
| At1g27370 | GATGGACTGCAACATGGTATCTTCGTTCCC | SEQ ID NO: 199 | GATGAAATGACTAGGGAAAGTGCCAAATAT | SEQ ID NO: 200 |
| At1g27730 | GATGGCGCTCGAGGCTCTTACATCACCAAG | SEQ ID NO: 201 | AAGTTGAAGTTTGACCGGAAAGTCAAACCG | SEQ ID NO: 202 |
| At1g28160 | ATGGAGTTCAATGGTAATTTGAATG | SEQ ID NO: 203 | TTGGTAGAAGAATGTGGAGGG | SEQ ID NO: 204 |
| At1g28520 | GATGACGGGGAAGCGATCAAAGAC | SEQ ID NO: 205 | GGGGATATAATAGTCGCTTAGATTTC | SEQ ID NO: 206 |
| At1g30210 | ATGGAGGTTGACGAAGACATTG | SEQ ID NO: 207 | TCTCCTTTCCTTTGCCTTGTC | SEQ ID NO: 208 |
| At1g30810 | GATGGAAAATCCTCCATTAGAATCTGAGAT | SEQ ID NO: 209 | CATCAAATCTACTCCGAAAAGTTTTCCTTT | SEQ ID NO: 210 |
| At1g32770 | GATGGCTGATAATAAGGTCAATCTTTCGAT | SEQ ID NO: 211 | TACAGATAAATGAAGAAGTGGGTCTAAAGA | SEQ ID NO: 212 |
| At1g33760 | ATGGAAAACACTTACGTTGGCC | SEQ ID NO: 213 | ATTATTAGAATTCCATATGGACTG | SEQ ID NO: 214 |
| At1g34190 | GATGGCGGATTCTTCACCCGATTCG | SEQ ID NO: 215 | GTCTTTCAAGAGAAGACTTCTACC | SEQ ID NO: 216 |
| At1g36060 | ATGGCGGATCTCTTCGGTGG | SEQ ID NO: 217 | CGATAAAATTGAAGCCCAATCTATC | SEQ ID NO: 218 |
| At1g43160 | ATGGTGTCTATGCTGACTAATG | SEQ ID NO: 219 | ACCAAAAGAGGAGTAATTGTATTG | SEQ ID NO: 220 |
| At1g43640 | GATGTCGTTTCTGAGTATTGTTCGTGATGT | SEQ ID NO: 221 | TTCACATGCCAATTTAGTATCAAAGGTGCT | SEQ ID NO: 222 |
| At1g44830 | ATGGTGAAAACACTTCAAAAGACAC | SEQ ID NO: 223 | GCAGAAGTTCCATAATCTGATATC | SEQ ID NO: 224 |
| At1g49120 | ATGATCAGTTTCAGAGAAGAGAAC | SEQ ID NO: 225 | TAAAAACTTATCGATCCAATCAGTAG | SEQ ID NO: 226 |
| At1g52150 | GATGGCAATGTCTTGCAAGGATGGTAAGTT | SEQ ID NO: 227 | CACAAAGGACCAATTGATGAACACAAAGCA | SEQ ID NO: 228 |
| At1g52880 | GATGGAGAGTACAGATTCTTCCGGTGGTCC | SEQ ID NO: 229 | AGAATACCAATTCAAACCAGGCAATTGGTA | SEQ ID NO: 230 |
| At1g52890 | GATGGGTATCCAAGAAACTGACCCGTTAAC | SEQ ID NO: 231 | CATAAACCCAAACCCACCAACTTGCCCCGA | SEQ ID NO: 232 |
| At1g53230 | GATGAAGAGAGATCATCATCATCATCATCA | SEQ ID NO: 233 | ATGGCGAGAATCGGATGAAGC | SEQ ID NO: 234 |
| At1g56010 | GATGGAGACGGAAGAAGAGATGAAG | SEQ ID NO: 235 | GCAATTCCAAACAGTGCTTGGAATAC | SEQ ID NO: 236 |
| At1g56650 | GGGATGGAGGGTTCGTCCAAAGGGCTGCGAAAAGG | SEQ ID NO: 237 | ATCAAATTTCACAGTCTCCATCGAAAAGACTCC | SEQ ID NO: 238 |
| At1g60240 | GATGAAGTCAAGACGTGAACAATCAATCGA | SEQ ID NO: 239 | TTTATAGTAACCTCGAATGTGCTGGGCCAA | SEQ ID NO: 240 |
| At1g61110 | GATGGAAAACATGGGGGATTCGAGCATAG | SEQ ID NO: 241 | TGAGTGCCAGTTCATGTTAGGAAGCTG | SEQ ID NO: 242 |
| At1g62700 | GATGAATTCGTTTTCACAAGTACCTCCTGG | SEQ ID NO: 243 | GAGATCAATCTGACAACTTGAAGAAGTAGA | SEQ ID NO: 244 |
| At1g63040 | ATGGCTGACCCTAACAATCCTATC | SEQ ID NO: 245 | ATAGCTCCACAAGGTCTCTCC | SEQ ID NO: 246 |
| At1g63910 | GATGGGTCATCACTCATGCTGCAACCAGOA | SEQ ID NO: 247 | AAACGAAGAAGGGAAAGAAGAAGATAAGGC | SEQ ID NO: 248 |
| At1g64380 | ATGGAAGAAAGCAATGATATTTTTC | SEQ ID NO: 249 | ATTGGCAAGAACTTCCCAAATCAG | SEQ ID NO: 250 |
| At1g67260 | ATGTCGTCTTCCACCAATGAC | SEQ ID NO: 251 | GTTTACAAAAGAGTCTTGAATCC | SEQ ID NO: 252 |
| At1g67780 | GATGGCTATTGAGGGTGAGAAAGAGAAACC | SEQ ID NO: 253 | TGCTACCACATTTGTGTTCTTCAATUTTG | SEQ ID NO: 254 |
| At1g68800 | ATGTTTCCTTCTTTCATTACTCAC | SEQ ID NO: 255 | ATTAGGGTTTTTAGTTAACACATTG | SEQ ID NO: 256 |
| At1g69120 | GATGGGAAGGGGTAGGGTTCAATTGAAGAG | SEQ ID NO: 257 | TGCGGCGAAGCAGCCAAGGTTGCAGTTGTA | SEQ ID NO: 258 |
| At1g69490 | GATGGAAGTAACTTCCCAATCTACCCCC | SEQ ID NO: 259 | AAACTTAAACATCGCTTGACGATGATGGTT | SEQ ID NO: 260 |
| At1g71030 | GATGAACAAAACCCGCCTTCGTCTCTCTC | SEQ ID NO: 261 | TCGGAATAGAAGAAGCGTTTCTTGACCTGT | SEQ ID NO: 262 |
| At1g71450 | ATGGCTGGTCTTAGGAATTCCG | SEQ ID NO: 263 | AGGGTCCCAAAGAAAGTCACTC | SEQ ID NO: 264 |

TABLE 3-continued

| AGI code | Foward primer | Nucleotide sequence | Reverse primer | Nucleotide sequence |
|---|---|---|---|---|
| At1g71692 | GATGGCTCGTGGAAAGATTCAGCTTAAGAG | SEQ ID NO: 265 | GAACTGAAATATTTCACTTGGCATTGTTAG | SEQ ID NO: 266 |
| At1g72360 | ATGTGCGGAGGAGCTGTAATTTC | SEQ ID NO: 267 | GGACCATAGACCCATGTCATTG | SEQ ID NO: 268 |
| At1g72570 | ATGAAGAAATGGTTGGGATTTTCATTG | SEQ ID NO: 269 | GTGGCCGGCGCCAGAGCTGGTG | SEQ ID NO: 270 |
| At1g74840 | GATGGCCGACGGTAGTACTAGTTCTTCGGA | SEQ ID NO: 271 | AGCGACTCCAATCGTGTTGAATGCTGGATG | SEQ ID NO: 272 |
| At1g74930 | ATGGTGAAGCAAGCGATGAAGG | SEQ ID NO: 273 | AAAATCCCAAAGAATCAAAGATTC | SEQ ID NO: 274 |
| At1g76580 | GATGGATGTTATGGCTTTGTTAACAGCTTT | SEQ ID NO: 275 | ACTCTTTGCAAATCGTGGCATTGGCTCAAT | SEQ ID NO: 276 |
| At1g77200 | ATGACCGAGTCATCCATTATCTC | SEQ ID NO: 277 | AGGAAAAAGGGGGCCAAAATTG | SEQ ID NO: 278 |
| At1g77450 | GATGATGAAATCTGGGGCTGATTTGC | SEQ ID NO: 279 | GAAAGTTCCCTGCCTAACCACAAGTGG | SEQ ID NO: 280 |
| At1g78080 | GATGGCAGCTGCTATGAATTTGTAC | SEQ ID NO: 281 | AGCTAGAATCGAATCCCAATCG | SEQ ID NO: 282 |
| At1g79180 | GATGGGGAAGGGAAGAGCACCTTGTTGTGA | SEQ ID NO: 283 | ATGTATCATGAGCTCGTAGTTCTTCAAGAG | SEQ ID NO: 284 |
| At1g80580 | ATGGAAAACAGCTACACCGTTG | SEQ ID NO: 285 | CTTCCTAGACAACAACCCTAAAC | SEQ ID NO: 286 |
| At2g02070 | GATGGCTGCTTCTTCATCCTCCGCTGCTTC | SEQ ID NO: 287 | GAAACTCGCATGATGGATTCCATAAGGIGG | SEQ ID NO: 288 |
| At2g02450 | GATGGCGGCGATAGGAGAGAAAG | SEQ ID NO: 289 | CTTAAAAGGAATATTAGTATAGTG | SEQ ID NO: 290 |
| At2g17040 | GATGGTTTACGGTAAGAGATCGAG | SEQ ID NO: 291 | CCAATATATGTTAACTATTGGTG | SEQ ID NO: 292 |
| At2g18060 | GATGGAGCCAATGGAATCTTGTAGCGTTCC | SEQ ID NO: 293 | ATTATCAAATACGCAAATCCCAATATCATA | SEQ ID NO: 294 |
| At2g22200 | ATGGAAACTGCTTCTCTTCTTTC | SEQ ID NO: 295 | AGAATTGGCCAGTTTACTAATTGC | SEQ ID NO: 296 |
| At2g23290 | GATGTCTGGTTCGACCCGGAAAGAAATGGA | SEQ ID NO: 297 | CTCGATCCTACCTAATCCAATAAACTCTCT | SEQ ID NO: 298 |
| At2g23760 | GATGGGTTTAGCTACTACAACTTCTTCTAT | SEQ ID NO: 299 | AAAATCTCCAAAGTCTCTAACGGAGAAAGA | SEQ ID NO: 300 |
| At2g26060 | GATGGATTTGATGGAGAAGAACTTGGAGTT | SEQ ID NO: 301 | CGGTTTAGTTGCAAGCTGCCAAATCTTGAC | SEQ ID NO: 302 |
| At2g28550 | GATGTTGGATCTTAACCTCAACGC | SEQ ID NO: 303 | AGGGTGTGGATAAAAGTAACCAC | SEQ ID NO: 304 |
| At2g30420 | GATGGATAATACCAACCGTCTTCGTCTTCG | SEQ ID NO: 305 | CAATTTTAGATTTTCTTGGAGATTAAGAGG | SEQ ID NO: 306 |
| At2g30470 | GATGTTTGAAGTCAAAATGGGGTCAAAGAT | SEQ ID NO: 307 | GCTTGAAACTCTCGGCTCTTCACGAACATT | SEQ ID NO: 308 |
| At2g31230 | ATGTATTCATCTCCAAGTTCTTGG | SEQ ID NO: 309 | ACATGAGCTCATAAGAAGTTGTTC | SEQ ID NO: 310 |
| At2g33480 | GATGGAGAAGAGGAGCTCTATTAAAAACAG | SEQ ID NO: 311 | TAGAAACAAACAAAACTTATTTTCCCGATA | SEQ ID NO: 312 |
| At2g33710 | ATGCATAGCGGGAAGAGACCTC | SEQ ID NO: 313 | TTTTCGTCGTTTGTGGATACTAATG | SEQ ID NO: 314 |
| At2g35700 | ATGGAACGTGACGACTGCCGG | SEQ ID NO: 315 | GTAACTTTGAGAGAGGAAGGGTTC | SEQ ID NO: 316 |
| At2g40220 | ATGGACCCTTTAGCTTCCCAAC | SEQ ID NO: 317 | ATAGAATTCCUCAAGATGGGATO | SEQ ID NO: 318 |
| At2g41710 | GATGGCGTCGGTGTCGTCGTC | SEQ ID NO: 319 | TTTCTCTTGTGGGAGGTAGCTG | SEQ ID NO: 320 |
| At2g42400 | GATGAAGAGAACACATTTGGCAAGTTTTAG | SEQ ID NO: 321 | GAGGTAGCCTAGTCGAAGCTCCAAATCAAG | SEQ ID NO: 322 |
| At2g42830 | GATGGAGGGTGGTGCGAGTAATGAAGTAGC | SEQ ID NO: 323 | AACAAGTTGCAGAGGTGGTTGGTCTTGGTT | SEQ ID NO: 324 |
| At2g44840 | ATGAGCTCATCTGATTCCGTTAATAAC | SEQ ID NO: 325 | TATCCGATTATCAGAATAAGAACATTC | SEQ ID NO: 326 |
| At2g44940 | ATGGCAAGACAAATCAACATAGAG | SEQ ID NO: 327 | TTCAGATAGAAAAAACGGCTCTTC | SEQ ID NO: 328 |
| At2g45650 | GATGGGAAGAGGGAGAGTGGAGATGAAGAG | SEQ ID NO: 329 | AAGAACCCAACCTTGGACGAAATTAGTCTC | SEQ ID NO: 330 |
| At2g45680 | ATGGCGACAATTCAGAAGCTTG | SEQ ID NO: 331 | GTGGTTCGATGACCGTGCTG | SEQ ID NO: 332 |
| At2g46310 | ATGAAAAGCCGAGTGAGAAAATC | SEQ ID NO: 333 | TTACTTATCCAACAAATGATCTTGG | SEQ ID NO: 334 |
| At2g46590 | GATGATGAACGTTAAACCAATGGAGCAGAT | SEQ ID NO: 335 | CCATGAAGATCCTCCTCCTGTAGTACTGAA | SEQ ID NO: 336 |
| At2g47520 | ATGTGTGGGGGAGCTATCATTTC | SEQ ID NO: 337 | ATTGGAGTCTTGATAGCTCC | SEQ ID NO: 338 |
| At3g01530 | GATGGAGACGACGATGAAGAAGAAAGGGAG | SEQ ID NO: 339 | AATCACATGGTGGTCACCATTAAGCAAGTG | SEQ ID NO: 340 |
| At3g02150 | ATGAATATCGTCTCTTGGAAAGATG | SEQ ID NO: 341 | ATTGGTGGAGAGTTTCCAAGCCGAGGTGGC | SEQ ID NO: 342 |

TABLE 3-continued

| AGI code | Foward primer | Nucleotide sequence | Reverse primer | Nucleotide sequence |
|---|---|---|---|---|
| At3g02310 | GATGGGAAGAGGAAGAGTAGAGCTCAAGAG | SEQ ID NO: 343 | CAGCATCCAGCCAGGGATGTAGCCGTTTCC | SEQ ID NO: 344 |
| At3g04060 | GATGGTHAAGAAGGCGGCGTAG | SEQ ID NO: 345 | GCTAGTATATAAATCTTCCCAGAAG | SEQ ID NO: 346 |
| At3g04070 | GATGATAAGCAAGGATCCAAGATCGAGTTT | SEQ ID NO: 347 | GCCTTGATATTGAAGGTGAGAACTCATCAT | SEQ ID NO: 348 |
| At3g04420 | GATGGAGAATCGGTGGGTTTAAG | SEQ ID NO: 349 | TGTTCTTGAGATAGAAGAACATTGG | SEQ ID NO: 350 |
| At3g05760 | GATGGCTTCGAGCAACACGACTACTGGGGT | SEQ ID NO: 351 | TGATTTTTTTGAAGATCCAAAGCCCCCAAA | SEQ ID NO: 352 |
| At3g09600 | GATGAGCTCGTCGCCGTCAAGAAATCCAAC | SEQ ID NO: 353 | TGOTGATTTGTCGCTTGTTGAGTTCTTGAC | SEQ ID NO: 354 |
| At3g10490 | GATGGGTCGCGAATCTGTGGCTGTTG | SEQ ID NO: 355 | TTGTCCATTAGCATTGTTCTTCTTG | SEQ ID NO: 356 |
| At3g11280 | GATGGAGACTCTGCATCCATTCTCTCACCT | SEQ ID NO: 357 | AGCTCCGCCACTGAAGACATTTTCTCCGGC | SEQ ID NO: 358 |
| At3g14230 | ATGTGTGGAGGAGCTATAATCTC | SEQ ID NO: 359 | AAAGTCTCCTTCCAGCATGAAATTG | SEQ ID NO: 360 |
| At3g15500 | GATGGGTCTCCAAGAGCTTGACCCGTTAGC | SEQ ID NO: 361 | AATAAACCCGAACCCACTAGATTGTTGACC | SEQ ID NO: 362 |
| At3g15510 | GATGGAGAGCACCGATTCTTCCGGTGGTCC | SEQ ID NO: 363 | AGAAGAGTACCAATTTAAACCGGGTAATTG | SEQ ID NO: 364 |
| At3g18550 | ATGAACAACAACATTTTCAGTACTAC | SEQ ID NO: 365 | ACTGTGTATAGCTTTAGATAAAACC | SEQ ID NO: 366 |
| At3g20770 | GATGATGTTTAATGAGATGGGAATGTGTGG | SEG ID NO: 367 | GAACCATATGGATACATCTTGCTGCTTCTG | SEQ ID NO: 368 |
| At3g23220 | ATGAAATACAGAGGCGTACGAAAG | SEQ ID NO: 369 | GCGGTTTGCGTCGTTACAATTG | SEQ ID NO: 370 |
| At3g23230 | ATGGAGAGCTCAAACAGGAGC | SEQ ID NO: 371 | TCTCTTCCTTTCTTCTGAATCAAG | SEQ ID NO: 372 |
| At3g23240 | CATGGATCCATTTTTAATTCAGTCC | SEQ ID NO: 373 | CCAAGTCCCACTATTTTCAGAAG | SEQ ID NO: 374 |
| At3g25890 | ATGGCTGAACGAAAGAAACGC | SEQ ID NO: 375 | TGGGCACGCGATATTAAGAGG | SEQ ID NO: 376 |
| At3g27920 | GATGAGAATAAGGAGAAGAGATGAAAAAGA | SEQ ID NO: 377 | AAGGCAGTACTCAACATCACCAGAAGCAAA | SEQ ID NO: 378 |
| At3g28910 | GATGGTGAGGCCTCCTTGTTGTGACAAAGG | SEQ ID NO: 379 | GAAGAAATTAGTGTTTTCATCCAATAGAAT | SEQ ID NO: 380 |
| At3g29035 | GATGGATTACAAGGTATCAAGAAG | SEG ID NO: 381 | GAATTTCCAAACGCAATCAAGATTC | SEQ ID NO: 382 |
| At3g45150 | ATGGATTCGAAAAATGGAATTAAC | SEQ ID NO: 383 | AACTGTGGTTGTGGCTGTTGTTG | SEQ ID NO: 384 |
| At3g49850 | GATGGGAGCTCCAAAGCTGAAGTGGACACC | SEQ ID NO: 385 | CCGAGTTTGGCTATGCATTCTATACTTCAC | SEQ ID NO: 386 |
| At3g54320 | ATGAAGAAGCGCTTAACCACTTC | SEQ ID NO: 387 | GACCAAATAGTTACAAGAAACCGAG | SEQ ID NO: 388 |
| At3g61910 | GATGAACATATCAGTAAACGGACAGTCACA | SEQ ID NO: 389 | TCCACTACCGTTCAACAAGTGGCATGTCGT | SEQ ID NO: 390 |
| At4g01060 | GATGGATAACCATCGCAGGACTAAGCAACC | SEQ ID NO: 391 | ATTTTTCATGACCCAAAACCTCTCAATTTC | SEQ ID NO: 392 |
| At4g01550 | GATGGTGAAAGATCTGGTTGGG | SEQ ID NO: 393 | TCTCTCGCGATCAAACTTCATCGC | SEQ ID NO: 394 |
| At4g18390 | ATGATTGGAGATCTAATGAAG | SEQ ID NO: 395 | GTTCTTGCCTTTACCCTTATG | SEQ ID NO: 396 |
| At4g18450 | ATGGCTTTTGGCAATATCCAAG | SEQ ID NO: 397 | AAAAGAAGATAATAACGTCTCC | SEQ ID NO: 398 |
| At4g23750 | ATGGAAGCGGAGAAGAAAATGG | SEQ ID NO: 399 | AACAGCTAAAAGAGGATCCGAC | SEQ ID NO: 400 |
| At4g26150 | GATGGGTTCCAATTTTCATTACACAATAGA | SEQ ID NO: 401 | CCCGTGAACCATTCCGTGCGATAGAGCCAT | SEQ ID NO: 402 |
| At4g27950 | ATGATGATGGATGACTTTATGGATC | SEQ ID NO: 403 | CACAAGTAAGAGATCGGATATC | SEQ ID NO: 404 |
| At4g28140 | ATGGACTTTGACGAGGAGCTAAATC | SEQ ID NO: 405 | AAAGAAAGGCCTCATAGGACAAG | SEQ ID NO: 406 |
| At4g28530 | GATGGGTTTGAAAGATATTGGGTCC | SEQ ID NO: 407 | TTGGAAAGCGAGGATATTTTCGGTC | SEQ ID NO: 408 |
| At4g31060 | ATGCCACCCTCTCCTCCTAAATC | SEQ ID NO: 409 | GTTTATCCAATCAATGTCCATCATG | SEQ ID NO: 410 |
| At4g31270 | GATGGAGGAAGGAACTTCAGGTTCACGGAG | SEQ ID NO: 411 | CTCGATTTCTTGTGGAACTTCATGAAGCCT | SEQ ID NO: 412 |
| At4g32800 | ATGGCGGATTCGTCTTCCGAC | SEQ ID NO: 413 | GGGAAAATGTTTCCAAGATTCG | SEO ID NO: 414 |
| At4g34410 | ATGCATTATCCTAACAACAGAACC | SEQ ID NO: 415 | CTGGAACATATCAGCAATTGTATTTC | SEQ ID NO: 416 |
| At4g35580 | GATGCTGCAGTCTGCAGCACCAGAG | SEQ ID NO: 417 | TGAACTCACCAGTGTCCTCCATATAC | SEQ ID NO: 418 |
| At4g36160 | GATGGAATCGGTGGATCAATCATGTAGTGT | SEQ ID NO: 419 | AACATGTAAATCCCTATATAAGTCATAGTC | SEQ ID NO: 420 |

TABLE 3-continued

| AGI code | Foward primer | Nucleotide sequence | Reverse primer | Nucleotide sequence |
|---|---|---|---|---|
| At4g37750 | ATGAAGTCTTTTTGTGATAATGATG | SEQ ID NO: 421 | AGAATCAGCCCAAGCAGCGAAAACCGG | SEQ ID NO: 422 |
| At4g38620 | GATGGGAAGGTCACCGTGCTGTGAGAAAGC | SEQ ID NO: 423 | TTTCATCTCCAAGCTTCGAAAGCCCAAAAG | SEQ ID NO: 424 |
| At4g39780 | ATGGCAGCCATAGATATGTTCAATAGC | SEQ ID NO: 425 | AGATTCGGACAATTTGCTAATCGC | SEQ ID NO: 426 |
| At5g02460 | GATTTTTTTCTTCATTTCCTACTTATCC | SEQ ID NO: 427 | TATATTGCTAGTAGAAGAAGAACTGAAATT | SEQ ID NO: 428 |
| At5g06100 | GATGAGTTACACGAGCACTGACAGTGACCA | SEQ ID NO: 429 | ACAAACTATTTCAAGTGATGGTAAGGTGAA | SEQ ID NO: 430 |
| At5g07310 | ATGGCGAATTCAGGAAATTATGG | SEQ ID NO: 431 | AAAACCAGAATTAGGAGGTGAAG | SEQ ID NO: 432 |
| At5g07580 | ATGGCGAGTTTTGAGGAAAGC | SEQ ID NO: 433 | AAATGCATCACAGGAAGATGAAG | SEQ ID NO: 434 |
| At5g07680 | GATGGATTTGCCTCCTGGTTTTAG | SEQ ID NO: 435 | GTAATTCCAGAAAGGTTCAAGATC | SEQ ID NO: 436 |
| At5g07690 | GATGTCAAGAAAGCCATGTTGTGTGGGAGA | SEQ ID NO: 437 | TATGAAGTTCTTGTCGTCGTAATCTTGGCT | SEQ ID NO: 438 |
| At5g08070 | ATGGGAATAAAAAAAGAAGATCAG | SEQ ID NO: 439 | CTCGATATGGTCTGGTTGTGAG | SEQ ID NO: 440 |
| At5g08790 | GATGAAGTCGGAGCTAAATTTACCAGCTGG | SEQ ID NO: 441 | CCCCTGTGGAGCAAAACTCCAATTCAAGAA | SEQ ID NO: 442 |
| At5g09330 | GATGGGAAAACTCAACTCGCTCCTGGATT | SEQ ID NO: 443 | CATTTTTGGTCTATGTCTCATGGAAGCAGA | SEQ ID NO: 444 |
| At5g13180 | GATGGATAATGTCAAACTTGTTAAGAATGG | SEQ ID NO: 445 | TCTGAAACTATTGCAACTACTGGTCTCTTC | SEQ ID NO: 446 |
| At5g13330 | ATGGTCTCCGCTCTCAGCCG | SEQ ID NO: 447 | TTCTCTTGGGTAGTTATAATAATTG | SEQ ID NO: 448 |
| At5g13910 | ATGAACACAACATCATCAAAGAGC | SEQ ID NO: 449 | GGAGCCAAAGTAGTTGAAACCTTG | SEQ ID NO: 450 |
| At5g14000 | GATGGAGGTGGAGAAGAGGATTGTAG | SEQ ID NO: 451 | CTCATCAGCTGAGGTAGGAGGAG | SEQ ID NO: 452 |
| At5g18270 | GATGGCGGTTGTGGTTGAAGAAGG | SEQ ID NO: 453 | GAAGTCCCACAAGTCCCCCCTC | SEQ ID NO: 454 |
| At5g18560 | ATGGGTTTTGCTCTGATCCACC | SEQ ID NO: 455 | AAAGACTGAGTAGAAGCCTGTAG | SEQ ID NO: 456 |
| At5g18830 | GATUCTTCTCTGTCGCAATCGCCACCACC | SEQ ID NO: 457 | AATTTGTGTACCAATCTCATTCGGATTGC | SEQ ID NO: 458 |
| At5g22290 | GATGGACACGAAGGCGGTTGGAGTTTC | SEQ ID NO: 459 | TTCTAGATAAAACAACATTGCTATC | SEQ ID NO: 460 |
| At5g22380 | GATGGCCGATGAGGTCACAATCGGTTTCG | SEQ ID NO: 461 | AGGCCAAGTCAGCTGTTCCCAGTCCCACAT | SEQ ID NO: 462 |
| At5g23260 | GATGGGTAGAGGGAAGATAGAGATAAAGAA | SEQ ID NO: 463 | ATCATTCTGGGCCGTTGGATCGTTTTGAAG | SEQ ID NO: 464 |
| At5g24520 | GATGGATAATTCAGCTCCAGATTCGTTATC | SEQ ID NO: 465 | AACTCTAAGGAGCTGCATTTTGTTAGCAAA | SEQ ID NO: 466 |
| At5g24590 | GATGAAAGAAGACATGGAAGTACTATC | SEQ ID NO: 467 | TGCGACTAGACTGCAGACCGACATC | SEQ ID NO: 468 |
| At5g25190 | ATGGCACGACCACAACAACGC | SEQ ID NO: 469 | CAGCGTCTGAGTTGGTAAAACAG | SEQ ID NO: 470 |
| At5g25390 | ATGGTACATTCGAAGAAGTTCCG | SEQ ID NO: 471 | GACCTGTGCAATGGATCCAG | SEQ ID NO: 472 |
| At5g25810 | ATGATAGCTTCAGAGAGTACCAAG | SEQ ID NO: 473 | ATAATTATACAGTCCTTGAAGATCCC | SEQ ID NO: 474 |
| At5g35550 | GATGGGAAAGAGAGCAACTACTAGTGTGAG | SEQ ID NO: 475 | ACAAGTGAAGTCTCGGAGCCAATCTTCATC | SEQ ID NO: 476 |
| At5g39610 | GATGGATTACGAGGCATCAAGAATC | SEQ ID NO: 477 | GAAATTCCAAACGCAATCCAATTC | SEQ ID NO: 478 |
| At5g40330 | ATGAGAATGACAAGAGATGGAAAAG | SEQ ID NO: 479 | AAGGCAATACCCATTAGTAAAATCCATCATAG | SEQ ID NO: 480 |
| At5g41030 | ATGGTCATGGAGCCCAAGAAG | SEQ ID NO: 481 | TGAACCATTTTCCTCTGCACTC | SEQ ID NO: 482 |
| At5g43270 | GATGGAGTGTAATGCAAAGCCACCGTTTCA | SEQ ID NO: 483 | GTTATAAAACTGGTTCAAGCTGAAGTAGTT | SEQ ID NO: 484 |
| At5g47220 | GATGTACGGACAGTGCAATATAGAATCCG | SEQ ID NO: 485 | TGAAACCAATAACTCATCAACACGTGT | SEQ ID NO: 486 |
| At5g41230 | GGGGATGGCGACTCCTAACGAAGT | SEQ ID NO: 487 | AACAACGGTCAACTGGGAATAACCAAACG | SEQ ID NO: 488 |
| At5g47390 | GATGACTCGTCGATGTTCTCACTGCAATCA | SEQ ID NO: 489 | TAAAGCGTGTATCACGCTTTTGATGTCTGA | SEG ID NO: 490 |
| At5g51190 | ATGGCTTCTTCACATCAACAACAG | SEQ ID NO: 491 | AGTAACTACGAGTTGAGAGTGTC | SEQ ID NO: 492 |
| At5g52020 | ATGTCGAATAATAATAATTCTCCGAC | SEQ ID NO: 493 | TTTATAACTCCAAAGATTATCTCCTTC | SEQ ID NO: 494 |
| At5g53290 | ATGGACGAATATATTGATTTCCGAC | SEQ ID NO: 495 | AGCAACTAATAGATCTGATATCAATG | SEQ ID NO: 496 |
| At5g54230 | GATCGGAAAATCTTCAAGCTCGGAGGAAAG | SEQ ID NO: 497 | TGATAGATTCAAAGCATTATTATTATGATC | SEQ ID NO: 498 |

TABLE 3-continued

| AGI code | Foward primer | Nucleotide sequence | Reverse primer | Nucleotide sequence |
|---|---|---|---|---|
| At5g58900 | GATGGAGGTTATGAGACCGTCGACGTCACA | SEQ ID NO: 499 | TAGTTGAAACATTGTGTTTTGGGCGTCATA | SEQ ID NO: 500 |
| At5g60970 | ATGAGATCAGGAGAATGTGATG | SEQ ID NO: 501 | AGAATCTGATTCATTATCGCTAC | SEQ ID NO: 502 |
| At5g61600 | ATGGCAACTAAACAAGAAGCTITAG | SEQ ID NO: 503 | AGTGACGGAGATAACGGAAAAG | SEQ ID NO: 504 |
| At5g62380 | GATGGAAAGTCTCGCACACATTCCTCCCGG | SEQ ID NO: 505 | CGTGTGTGTATTTTGAGCCCAAGAGTAGAA | SEQ ID NO: 506 |
| At5g64530 | GATGAATCTACCACCGGGATTTAGG | SEQ ID NO: 507 | CGGTAAGCTTACTTCGTCAAGATC | SEQ ID NO: 508 |
| At5g64750 | ATGTGTGTCTTAAAAGTGGCAAATC | SEQ ID NO: 509 | GGAGGATGGACTATTATTGTAG | SEG ID NO: 510 |
| At5g66300 | GATGATGAAGGTTGATCAAGATTATTCGTG | SEQ ID NO: 511 | GTCTTCTCCACTCATCAAAAATTGAGACGC | SEQ ID NO: 512 |
| At5g67000 | ATGGATAATTCAGAAAATGTTC | SEQ ID NO: 513 | TCTCCACCGCCGTTTAATTC | SEQ ID NO: 514 |
| At5g67300 | GATGGCTGATAGGATCAAAGGTCCATGGAG | SEQ ID NO: 515 | CTCGATTCTCCCAACTCCAATTTGACTCAT | SEQ ID NO: 516 |
| At5g67580 | GATGGGTGCACCAAAGCAGAAGTGGACACC | SEQ ID NO: 517 | CCAAGGATGATTACGGATCCTGAACTTCAA | SEQ ID NO: 518 |

Production of Improved Transcription Factors

In order to add a repressor domain sequence to the 3' terminal of a transcription factor gene encoded by the above DNA fragment, p35SSXG, which is a vector having an SmaI site and a repressor domain sequence (amino acid sequence: GLDLDLELRLGFA (SEQ ID NO: 519)) downstream of a CaMV35S promoter, was used. In order to link a transcription factor gene sequence and a repressor domain sequence, p35SSXG was cleaved with SmaI. Each PCR amplification fragment encoding the relevant transcription factor obtained above was separately inserted at the cleavage site. Thus, 180 types vectors (each denoted by p35SSXG(TFs)) were produced. Here, each vector is denoted by p35SSXG(TFs), provided that "TFs" represents the AGI code for each transcription factor. For example, a vector having the transcription factor specified by At3g04070 is denoted by p35SSXG (At3g04070). Also, in the descriptions below, "TFs" is used in a similar manner to denote vectors and the like.

Construction of Improved Transcription Factor Expression Vectors pBCKH was used as a binary vector for gene introduction into plants with *Agrobacterium*. This vector was obtained by incorporating a casset of the Gateway vector conversion system (Invitrogen) into the HindIII site of pBIG(Hygr) (Nucleic Acids Res. 18,203 (1990)). In order to incorporate an improved transcription factor gene sequence into the vector, 180 types of p35SSXG(TFs) were each separately mixed with the vector, followed by a recombination reaction using GATEWAY LR clonase (Invitrogen). Thus, 180 types of vectors (each denoted by pBCKH-p35SSXG(TFs)) were produced.

Introduction of Improved Transcription Factor Gene Expression Vectors into Plants

*Arabidopsis thaliana* (Columbia (Col-0)) was used as a plant for introduction of an improved transcription factor. Gene introduction was carried out in accordance with "Transformation of *Arabidopsis thaliana* by vacuum infiltration" (http://www.bch.msu.edu/pamgreen/protocol.htm). Note that each plant was infected only by immersing it in an *Agrobacterium* bacterial liquid without conducting depressurization treatment. Specifically, an improved transcription factor expression vector (pBCKH-p35SSXG(TFs)) was introduced into the soil bacterium (*Agrobacterium tumefaciens*) strain (GV3101 (C58C1Rifr) pMP90 (Gmr), Koncz and Schell 1986)) by electroporation. For each vector, gene-transfected bacterial cells were cultured in 1 liter of a YEP medium containing antibioitics (kanamycin (Km): 50 µg/ml; gentamicin (Gm): 25 µg/ml; and rifampicin (Rif): 50 µg/ml)) until OD600 became 1. Subsequantly, bacterial cells were recovered from each culture solution and suspended in 1 liter of an infection medium (an infiltration medium containing 2.2 g of an MS salt, 1×B5 vitamins, 50 g of sucrose, 0.5 g of MES, 0.044 µM of benzylaminopurine, and 400 µl of Silwet per litter (pH 5.7)).

*Arabidopsis thaliana* plants cultivated for 14 days were immersed in each solution for 1 minute for infection. Thereafter, the plants were continuously cultivated to result in seed setting. The collected seeds (T1 seeds) were sterilized in a solution containing 50% bleach and 0.02% Triton X-100 for 7 minutes, rinsed 3 times with sterilized water, and seeded on a sterilized hygromycin selection medium (containing a 4.3 g/l MS salt, 0.5% sucrose, 0.5 g/l MES (pH 5.7), 0.8% agar, 30 mg/l hygromycin, and 250 mg/l vancomycin). Five to ten lines of the transformed plants (T1 plants) growing on the hygromycin plate were selected for each improved transcription gene and transplanted into pots (each with a diameter of 50 mm) containing vermiculite mixed soil. Then, the plants were cultivated under conditions of 22° C. for 16 hours in the light and 8 hours in the dark at a light intensity ranging from about 60 to 80 µE/cm$^2$. Thus, seeds (T2 seeds) were obtained.

Analysis of T2 Seeds

T2 seeds from 5 to 10 lines of transformants prepared via transfecion with 180 types of TFs-SRDXs were analyzed for fat and oil content. *Arabidopsis thaliana* seeds (2 to 10 mg each) were subjected to quantitative analysis of fats and oils using MARAN-23 (ResonanceInsturuments Ltd., UK) H-NMR and analysis software (RI-NMR Ver. 2.0). Olive oil was used as a fat and oil reference substance to create a calibration curve for determination of the fat and oil content in seeds (% by weight).

Tables 4 to 6 summarize the analysis results of the fat and oil content in T2 seeds for the transformants obtained via transfection with the relevant TFs-SRDX genes.

TABLE 4

| AGI code | Genes | Fat and oil content (average) | Standard deviation | P value (t-test) |
|---|---|---|---|---|
| WT(Col-0) | WT(Col-0) | 34.9% | 3.8% | |
| At1g56650 | At1g56650-SRDX | 41.3% | 4.7% | 0.00% |
| At5g47230 | At5g47230-SRDX | 40.5% | 1.5% | 0.00% |
| At1g22985 | At1g22985-SRDX | 39.3% | 3.1% | 0.05% |
| At1g80580 | At1g80580-SRDX | 39.1% | 3.3% | 0.14% |

TABLE 4-continued

| AGI code | Genes | Fat and oil content (average) | Standard deviation | P value (t-test) |
|---|---|---|---|---|
| At1g25470 | At1g25470-SRDX | 39.0% | 2.6% | 0.04% |
| At1g67260 | At1g67260-SRDX | 38.7% | 3.4% | 0.39% |
| At5g24520 | At5g24520-SRDX | 38.3% | 2.4% | 0.15% |
| At1g71030 | At1g71030-SRDX | 38.3% | 3.3% | 0.57% |
| At4g36160 | At4g36160-SRDX | 37.9% | 3.0% | 1.34% |
| At3g15510 | At3g15510-SRDX | 37.9% | 3.3% | 2.11% |
| At5g64750 | At5g64750-SRDX | 37.1% | 2.1% | 2.03% |
| At5g07580 | At5g07580-SRDX | 37.1% | 3.8% | 11.48% |
| At5g61600 | At5g61600-SRDX | 37.0% | 3.7% | 13.06% |
| At1g74930 | At1g74930-SRDX | 37.0% | 2.7% | 5.61% |
| At2g31230 | At2g31230-SRDX | 36.7% | 1.1% | 1.81% |
| At4g01550 | At4g01550-SRDX | 36.7% | 1.0% | 1.97% |
| At1g68800 | At1g68800-SRDX | 36.6% | 2.8% | 12.64% |
| At5g51190 | At5g51190-SRDX | 36.6% | 4.6% | 29.97% |
| At5g47390 | At5g47390-SRDX | 36.5% | 3.3% | 18.20% |
| At1g24260 | At1g24260-SRDX | 36.5% | 1.4% | 4.63% |
| At5g09330 | At5g09330-SRDX | 36.5% | 1.4% | 4.97% |
| At5g40330 | At5g40330-SRDX | 36.5% | 5.8% | 41.64% |
| At3g04420 | At3g04420-SRDX | 36.4% | 1.4% | 5.24% |
| At3g23240 | At3g23240-SRDX | 36.3% | 4.7% | 37.70% |
| At5g18560 | At5g18560-SRDX | 36.3% | 3.2% | 24.67% |
| At3g23220 | At3g23220-SRDX | 36.3% | 1.9% | 13.44% |
| At1g10200 | At1g10200-SRDX | 36.1% | 1.2% | 16.57% |
| At5g25810 | At5g25810-SRDX | 36.0% | 1.4% | 16.19% |
| At5g24590 | At5g24590-SRDX | 35.9% | 1.9% | 23.99% |
| At1g15360 | At1g15360-SRDX | 35.8% | 5.0% | 60.12% |
| At4g31270 | At4g31270-SRDX | 35.8% | 2.1% | 33.95% |
| At3g11280 | At3g11280-SRDX | 35.7% | 3.2% | 48.17% |
| At2g40220 | At2g40220-SRDX | 35.7% | 1.8% | 32.94% |
| At2g46310 | At2g46310-SRDX | 35.6% | 1.8% | 39.17% |
| At1g72570 | At1g72570-SRDX | 35.6% | 1.6% | 37.63% |
| At2g44840 | At2g44840-SRDX | 35.6% | 1.8% | 43.45% |
| At3g45150 | At3g45150-SRDX | 35.5% | 5.7% | 75.03% |
| At5g67300 | At5g67300-SRDX | 35.4% | 2.6% | 59.92% |
| At3g14230 | At3g14230-SRDX | 35.4% | 2.8% | 63.53% |
| At4g27950 | At4g27950-SRDX | 35.3% | 2.1% | 65.97% |
| At5g25190 | At5g25190-SRDX | 35.3% | 3.7% | 77.19% |
| At2g42400 | At2g42400-SRDX | 35.3% | 1.7% | 64.86% |
| At5g06100 | At5g06100-SRDX | 35.2% | 1.1% | 68.48% |
| At5g67000 | At5g67000-SRDX | 35.2% | 1.7% | 72.40% |
| At5g64530 | At5g64530-SRDX | 35.2% | 1.4% | 70.59% |
| At3g05760 | At3g05760-SRDX | 35.1% | 4.8% | 89.74% |
| At1g63910 | At1g63910-SRDX | 35.1% | 2.4% | 82.95% |
| At5g35550 | At5g35550-SRDX | 35.0% | 1.7% | 86.61% |
| At3g61910 | At3g61910-SRDX | 35.0% | 5.6% | 94.10% |
| At4g37750 | At4g37750-SRDX | 34.8% | 2.4% | 98.10% |
| At1g24590 | At1g24590-SRDX | 34.8% | 3.4% | 96.18% |
| At5g23260 | At5g23260-SRDX | 34.8% | 1.6% | 94.23% |
| At1g78080 | At1g78080-SRDX | 34.8% | 1.1% | 92.81% |
| At2g22200 | At2g22200-SRDX | 34.8% | 3.1% | 92.51% |
| At5g08790 | At5g08790-SRDX | 34.7% | 2.2% | 89.22% |
| At1g43640 | At1g43640-SRDX | 34.7% | 1.8% | 86.52% |
| At1g79180 | At1g79180-SRDX | 34.7% | 2.1% | 84.04% |
| At5g25390 | At5g25390-SRDX | 34.7% | 1.7% | 81.22% |
| At2g28550 | At2g28550-SRDX | 34.6% | 2.6% | 82.85% |
| At4g39780 | At4g39780-SRDX | 34.6% | 2.1% | 79.62% |
| At5g39610 | At5g39610-SRDX | 34.5% | 3.6% | 80.18% |

TABLE 5

| AGI code | Genes | Fat and oil content (average) | Standard deviation | P value (t-test) |
|---|---|---|---|---|
| At4g23750 | At4g23750-SRDX | 34.5% | 3.3% | 77.60% |
| At4g35580 | At4g35580-SRDX | 34.5% | 2.4% | 67.37% |
| At2g33480 | At2g33480-SRDX | 34.4% | 2.2% | 64.16% |
| At3g02310 | At3g02310-SRDX | 34.4% | 1.9% | 57.72% |
| At4g34410 | At4g34410-SRDX | 34.3% | 4.2% | 71.90% |
| At5g58900 | At5g58900-SRDX | 34.3% | 2.8% | 59.57% |
| At5g53290 | At5g53290-SRDX | 34.2% | 2.9% | 52.74% |
| At1g01010 | At1g01010-SRDX | 34.1% | 1.3% | 34.04% |
| At3g25890 | At3g25890-SRDX | 34.1% | 2.2% | 43.34% |

TABLE 5-continued

| AGI code | Genes | Fat and oil content (average) | Standard deviation | P value (t-test) |
|---|---|---|---|---|
| At1g67780 | At1g67780-SRDX | 34.1% | 2.8% | 48.95% |
| At1g63040 | At1g63040-SRDX | 34.1% | 2.0% | 38.51% |
| At1g52890 | At1g52890-SRDX | 34.0% | 1.7% | 29.38% |
| At4g31060 | At4g31060-SRDX | 33.9% | 2.9% | 40.19% |
| At1g53230 | At1g53230-SRDX | 33.9% | 3.0% | 40.84% |
| At1g27370 | At1g27370-SRDX | 33.9% | 2.8% | 37.54% |
| At1g12980 | At1g12980-SRDX | 33.9% | 2.2% | 29.35% |
| At5g67580 | At5g67580-SRDX | 33.9% | 3.4% | 42.60% |
| At1g17520 | At1g17520-SRDX | 33.8% | 2.8% | 34.90% |
| At2g33710 | At2g33710-SRDX | 33.8% | 1.9% | 23.88% |
| At3g28910 | At3g28910-SRDX | 33.8% | 5.2% | 54.42% |
| At2g26060 | At2g26060-SRDX | 33.8% | 1.5% | 17.87% |
| At1g77200 | At1g77200-SRDX | 33.7% | 2.3% | 25.47% |
| At3g23230 | At3g23230-SRDX | 33.7% | 4.6% | 47.57% |
| At1g64380 | At1g64380-SRDX | 33.6% | 3.6% | 34.06% |
| At1g43160 | At1g43160-SRDX | 33.6% | 2.1% | 17.39% |
| At1g28160 | At1g28160-SRDX | 33.6% | 3.1% | 27.37% |
| At2g35700 | At2g35700-SRDX | 33.5% | 2.0% | 14.13% |
| At3g29035 | At3g29035-SRDX | 33.5% | 1.6% | 10.20% |
| At2g44940 | At2g44940-SRDX | 33.5% | 2.2% | 15.44% |
| At1g14510 | At1g14510-SRDX | 33.5% | 3.6% | 29.60% |
| At1g56010 | At1g56010-SRDX | 33.4% | 5.4% | 43.55% |
| At5g41030 | At5g41030-SRDX | 33.4% | 3.4% | 25.95% |
| At2g41710 | At2g41710-SRDX | 33.4% | 3.0% | 20.11% |
| At1g34190 | At1g34190-SRDX | 33.3% | 2.8% | 15.19% |
| At1g61110 | At1g61110-SRDX | 33.3% | 2.5% | 12.63% |
| At2g45680 | At2g45680-SRDX | 33.2% | 3.0% | 16.92% |
| At1g28520 | At1g28520-SRDX | 33.2% | 2.3% | 9.64% |
| At5g13910 | At5g13910-SRDX | 33.2% | 3.4% | 18.79% |
| At3g01530 | At3g01530-SRDX | 33.2% | 4.1% | 24.65% |
| At5g22290 | At5g22290-SRDX | 33.1% | 2.4% | 7.40% |
| At5g18270 | At5g18270-SRDX | 33.0% | 3.0% | 11.81% |
| At2g30470 | At2g30470-SRDX | 33.0% | 1.8% | 3.80% |
| At1g18570 | At1g18570-SRDX | 33.0% | 2.6% | 8.10% |
| At5g07680 | At5g07680-SRDX | 33.0% | 2.7% | 8.13% |
| At2g17040 | At2g17040-SRDX | 33.0% | 1.8% | 3.26% |
| At5g07690 | At5g07690-SRDX | 32.9% | 2.2% | 4.47% |
| At3g54320 | At3g54320-SRDX | 32.9% | 2.3% | 5.12% |
| At3g15500 | At3g15500-SRDX | 32.9% | 1.9% | 2.97% |
| At2g30420 | At2g30420-SRDX | 32.9% | 1.4% | 1.51% |
| At3g09600 | At3g09600-SRDX | 32.8% | 1.6% | 1.71% |
| At1g36060 | At1g36060-SRDX | 32.8% | 2.2% | 3.25% |
| At1g01250 | At1g01250-SRDX | 32.7% | 1.7% | 1.53% |
| At1g25580 | At1g25580-SRDX | 32.7% | 2.1% | 2.46% |
| At5g54230 | At5g54230-SRDX | 32.7% | 3.0% | 6.49% |
| At3g20770 | At3g20770-SRDX | 32.7% | 2.4% | 3.36% |
| At1g12890 | At1g12890-SRDX | 32.7% | 2.0% | 2.03% |
| At1g60240 | At1g60240-SRDX | 32.6% | 4.5% | 15.84% |

TABLE 6

| AGI code | Genes | Fat and oil content (average) | Standard deviation | P value (t-test) |
|---|---|---|---|---|
| At4g28530 | At4g28530-SRDX | 32.5% | 3.5% | 7.11% |
| At4g18450 | At4g18450-SRDX | 32.4% | 4.3% | 8.56% |
| At2g47520 | At2g47520-SRDX | 32.4% | 3.3% | 5.10% |
| At2g18060 | At2g18060-SRDX | 32.4% | 1.8% | 0.61% |
| At4g18390 | At4g18390-SRDX | 32.3% | 2.1% | 1.03% |
| At5g08070 | At5g08070-SRDX | 32.3% | 1.9% | 0.59% |
| At1g76580 | At1g76580-SRDX | 32.2% | 2.2% | 0.84% |
| At4g28140 | At4g28140-SRDX | 32.2% | 2.9% | 2.15% |
| At5g60970 | At5g60970-SRDX | 32.1% | 2.2% | 0.69% |
| At2g42830 | At2g42830-SRDX | 32.1% | 3.2% | 2.52% |
| At1g30210 | At1g30210-SRDX | 32.1% | 2.8% | 1.61% |
| At1g71450 | At1g71450-SRDX | 32.1% | 2.4% | 0.89% |
| At1g09540 | At1g09540-SRDX | 32.1% | 1.8% | 0.26% |
| At3g10490 | At3g10490-SRDX | 32.0% | 2.5% | 0.72% |
| At1g62700 | At1g62700-SRDX | 32.0% | 1.9% | 0.21% |
| At1g49120 | At1g49120-SRDX | 31.9% | 2.3% | 0.44% |
| At1g44830 | At1g44830-SRDX | 31.9% | 3.2% | 1.84% |
| At1g30810 | At1g30810-SRDX | 31.8% | 2.2% | 0.31% |

TABLE 6-continued

| AGI code | Genes | Fat and oil content (average) | Standard deviation | P value (t-test) |
| --- | --- | --- | --- | --- |
| At1g74840 | At1g74840-SRDX | 31.8% | 3.2% | 1.35% |
| At5g18830 | At5g18830-SRDX | 31.8% | 1.8% | 0.09% |
| At1g72360 | At1g72360-SRDX | 31.4% | 2.0% | 0.04% |
| At1g32770 | At1g32770-SRDX | 31.3% | 1.9% | 0.03% |
| At5g14000 | At5g14000-SRDX | 31.3% | 2.1% | 0.05% |
| At2g23290 | At2g23290-SRDX | 31.3% | 2.8% | 0.21% |
| At2g02450 | At2g02450-SRDX | 31.1% | 2.3% | 0.04% |
| At1g27360 | At1g27360-SRDX | 31.0% | 2.3% | 0.03% |
| At1g33760 | At1g33760-SRDX | 31.0% | 2.1% | 0.02% |
| At3g27920 | At3g27920-SRDX | 30.9% | 2.1% | 0.01% |
| At3g18550 | At3g18550-SRDX | 30.8% | 2.9% | 0.08% |
| At1g52880 | At1g52880-SRDX | 30.8% | 3.4% | 0.23% |
| At5g07310 | At5g07310-SRDX | 30.7% | 2.3% | 0.01% |
| At4g26150 | At4g26150-SRDX | 30.6% | 2.0% | 0.00% |
| At1g19490 | At1g19490-SRDX | 30.6% | 2.3% | 0.01% |
| At1g52150 | At1g52150-SRDX | 30.6% | 1.5% | 0.00% |
| At3g04060 | At3g04060-SRDX | 30.5% | 3.1% | 0.07% |
| At4g32800 | At4g32800-SRDX | 30.5% | 2.8% | 0.03% |
| At5g66300 | At5g66300-SRDX | 30.5% | 2.1% | 0.00% |
| At5g13180 | At5g13180-SRDX | 30.5% | 5.5% | 2.41% |
| At1g71692 | At1g71692-SRDX | 30.5% | 2.9% | 0.03% |
| At1g27730 | At1g27730-SRDX | 30.4% | 1.4% | 0.00% |
| At3g49850 | At3g49850-SRDX | 30.1% | 1.3% | 0.00% |
| At3g02150 | At3g02150-SRDX | 30.1% | 2.8% | 0.02% |
| At5g47220 | At5g47220-SRDX | 30.0% | 4.9% | 0.60% |
| At5g43270 | At5g43270-SRDX | 29.7% | 2.1% | 0.00% |
| At5g52020 | At5g52020-SRDX | 29.7% | 2.1% | 0.00% |
| At1g69490 | At1g69490-SRDX | 29.6% | 4.8% | 0.28% |
| At4g38620 | At4g38620-SRDX | 29.4% | 4.1% | 0.05% |
| At2g45650 | At2g45650-SRDX | 29.2% | 1.3% | 0.00% |
| At5g02460 | At5g02460-SRDX | 29.0% | 1.6% | 0.00% |
| At1g12260 | At1g12260-SRDX | 28.9% | 2.9% | 0.00% |
| At5g13330 | At5g13330-SRDX | 28.7% | 3.6% | 0.00% |
| At4g01060 | At4g01060-SRDX | 28.5% | 3.0% | 0.00% |
| At2g46590 | At2g46590-SRDX | 28.5% | 2.4% | 0.00% |
| At1g69120 | At1g69120-SRDX | 28.3% | 3.2% | 0.00% |
| At1g77450 | At1g77450-SRDX | 28.1% | 6.1% | 0.17% |
| At2g23760 | At2g23760-SRDX | 28.0% | 2.4% | 0.00% |
| At2g02070 | At2g02070-SRDX | 27.9% | 2.4% | 0.00% |
| At1g22640 | At1g22640-SRDX | 27.8% | 2.2% | 0.00% |
| At1g18330 | At1g18330-SRDX | 27.6% | 4.0% | 0.00% |
| At5g22380 | At5g22380-SRDX | 27.5% | 5.1% | 0.01% |
| At5g62380 | At5g62380-SRDX | 26.0% | 3.7% | 0.00% |
| At3g04070 | At3g04070-SRDX | 25.2% | 3.5% | 0.00% |

The fat and oil content in fructified seeds was found to be 34.9±3.8% for 33 untransfected control WT(Col-0) individuals. Meanwhile, the average fat and oil content in T2 seeds was found to be 25.2% to 41.3% for the transformants each overexpressing a chimeric protein comprising a different one of the 180 types of transcription factors fused with SRDX. For a comparison of the obtained average value with the average fat and oil content for the wild-type strain, a t-test was performed. Accordingly, T2 seeds expressing chimeric proteins from 15 lines (accounting for 8.3% of the analyzed transcription factors) were found to exhibit a significant increase in the fat and oil content (P<0.05). Meanwhile, T2 seeds expressing chimeric proteins from 70 lines (accounting for 38.9% of the analyzed transcription factors) were found to exhibit a significant decrease in fat and oil content (P<0.05). That is, expression of approximately 47.2% of chimeric proteins caused an increase or decrease in fat and oil content. In other words, about more than half of the transcription factors (e.g., At5g40330, At4g23750, and At5g18270) examined herein substantially do not influence the fat and oil content in seeds even when a chimeric protein comprising such a transcription factor and a repressor domain is expressed.

In this Example, each of the following 11 types of transcription factors was newly identified as a transcription factor capable of functioning to improve the fat and oil content in seeds when a chimeric protein comprising the transcription factor fused with a repressor domain was expressed: At5g47230, At1g22985, At1g80580, At1g25470, At1g67260, At4g36160, At5g64750, At4g01550, At1g24260, At5g09330, and At2g31230. Also in this Example, each of the following 68 types of transcription factors was newly identified as a transcription factor capable of functioning to reduce the fat and oil content in seeds when a chimeric protein comprising the transcription factor fused with a repressor domain was expressed: At2g17040, At5g07690, At3g15500, At2g30420, At3g09600, At1g36060, At1g01250, At1g25580, At3g20770, At1g12890, At2g18060, At4g18390, At5g08070, At1g76580, At4g28140, At5g60970, At2g42830, At1g30210, At1g71450, At1g09540, At3g10490, At1g62700, At1g49120, At1g44830, At1g30810, At1g74840, At5g18830, At1g72360, At1g32770, At5g14000, At2g23290, At2g02450, At1g27360, At1g33760, At3g27920, At3g18550, At1g52880, At5g07310, At4g26150, At1g19490, At1g52150, At3g04060, At4g32800, At5g66300, At5g13180, At1g71692, At1g27730, At3g49850, At3g02150, At5g47220, At5g43270, At5g52020, At1g69490, At4g38620, At2g45650, At5g02460, At1g12260, At5g13330, At4g01060, At2g46590, At1g69120, At1g77450, At2g23760, At2g02070, At1g22640, At5g22380, and At5g62380.

As described above, the Examples revealed that the fat and oil contents in seeds can be significantly modified by causing expression of a particular transcription factor fused with a repressor domain.

Production of a At5g22380-expressing Strain and Analysis of Fat and Oil Content

As described above, a DNA fragment of At5g22380 was amplified such that the fragment contained a termination codon. Then, the DNA fragment was ligated downstream of a 35S promoter in the manner described above and the ligation product was introduced into *Arabidopsis thaliana*. Specifically, an *Arabidopsis thaliana* transformant capable of expressing At5g22380 (which was in its original state and thus was not fused with SRDX) under the regulation of a constitutive expression promoter was produced for experimentation. The produced *Arabidopsis thaliana* transformant was subjected to determination of the fat and oil content in T2 seeds in the manner described above. Accordingly, the fat and oil content in T2 seeds was found to be 37.6±1.8% for plant individuals expressing At5g22380. Meanwhile, the fat and oil content was found to be 36.3±0.4% for the wild-type strain that had been cultivated in the same period. As a result of a t-test, a significant increase in the fat and oil content was confirmed (P<0.05). The fat and oil content of the line with the highest fat and oil content was found to be 40.0%, which was 10.3% greater than that of the wild-type strain.

The above experimental results revealed that a transcription factor expressed in a state of being fused with a repressor domain can significantly reduce the fat and oil content in seeds. This strongly suggested that the fat and oil content in seeds can be significantly improved when such transcription factor, which is originally not fused with a repressor domain, is expressed as is (that is to say, expressed under expression regulation by a constitutive expression promoter). Also, the above experimental results revealed that a transcription factor expressed in a state of being fused with a repressor domain can significantly improve the fat and oil content in seeds. This strongly suggested that the fat and oil content in seeds can be significantly reduced when such transcription factor, which is originally not fused with a repressor domain, is expressed as is (that is to say, expressed under expression regulation by a constitutive expression promoter).

All publications, patents, and patent applications cited herein are incorporated herein by reference in their entirety.

SEQUENCE LISTING (526 sequences)

SEQ ID NO: 1 - DNA, 903 bp, Arabidopsis thaliana
  CDS (1)..(903)
atggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttga

SEQ ID NO: 2 - protein, 300 aa, Arabidopsis thaliana
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 3 - DNA, 480 bp, Arabidopsis thaliana
  CDS (1)..(480)
atgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttga

SEQ ID NO: 4 - protein, 159 aa, Arabidopsis thaliana
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 5 - DNA, 771 bp, Arabidopsis thaliana
  CDS (1)..(771)
atggaaaacagctacaccgttgatggtcaccgtcttcaatattccgttccgttaagctccatgcatgaaaccagtcaaaactccgaaacttacggattatccaaagagtcgccgttggtctgcatgcccttgttcgaaaccaacactacttcattcgatatctcttctcttttctcgtttaacccaaaaccagaacccgaaaacacgcatcgtgtcatggacgattccatcgccgccgtcgtgggcgaaaacgttcttttcggtgataaaaacaaagtctctgatcacttgaccaaagaaggtggtgtgaagcgggggcggaagatgccgcagaagaccggaggattcatgggagtgagaaaacggccgtgggggagatggtcggcggagataagagacaggatagggcggtgcagacactggttaggaacgttcgacacggcggaagaggcagcgcgtgcgtatgacgcggcggcgaggaggcttagagggaccaaagccaagaccaatttcgtgattcctccgctttttcccaaggaaatagctcaggctcaggaggataataggatgaggcagaagcagaagaagaagaagaagaaaaaagtgagtgtgaggaagtgtgttaaagtcacatcggttgcacagttgttcgatgatgccaattttataaattcttctagtattaaaggaaatgtgattagttctattgataatcttgaaaaaatgggtctagagcttgatttgagtttagggttgttgtctaggaagtga

SEQ ID NO: 6 - protein, 256 aa, Arabidopsis thaliana
MENSYTVDGHRLQYSVPLSSMHETSQNSETYGLSKESPLVCMPLFETNTTSFDISSLFSFNPKPEPENTHRVMDDSIAAVVGENVLFGDKNKVSDHLTKEGGVKRGRKMPQKTGGFMGVRKRPWGRWSAEIRDRIGRCRHWLGTFDTAEEAARAYDAAARRLRGTKAKTNFVIPPLFPKEIAQAQEDNRMRQKQKKKKKKKVSVRKCVKVTSVAQLFDDANFINSSSIKGNVISSIDNLEKMGLELDLSLGLLSRK

SEQ ID NO: 7 - DNA, 864 bp, Arabidopsis thaliana
  CDS (1)..(864)
atgaagtcctttgtgaaacctgagagagactctttgttgagaacagttcgtattgttttcactgatcctgatgctactgatgattcctcttcctctagcgatgaatggttacctaaacctcgaaaggtaaagcgttttgttcatgagattactttcctccctcaggtctccgagagttctcaggatcgtagcaatgctgtcaaaacccctagaaggaaatctactaggcagtttaagtatcctgtgggagttaggccgaggccatcaggcaaatttgctgctgagattttgaacccattcactaaaactaagaaatggttgggtacttatgaaactcctgcagaagctgagaaggcttatgttgacaagaaggttgagtatgatgcactggcttcttcaggttctgctgtttcctcatcggttgtaacagtgactagccagtgcttgcgttcccctacttctgcttctgtttcttgtgtaagtgctgatgatttgtctaaagaaaagacgtctctgaacaaagatgttgctgcgtctggtgattcaaccaccaaagaagtgttcactactttcgacttttcggatgtgaaaatacctgatctgagattcttagcagcagaagaggattctatggtttctaatgcaaatggtgcagagctagactttgattgtttccttactgactctaacattctgctggatgattactcattgctcgaaaatgatatcaacttcagcaggtttgaaaacagtcttccaagtgagctacctgactgtgatttcactgaaatggaattccagcttgatgatttcaaatttgcctatacagatcatctgacaacaccgcctctcggtttggtttaa

SEQ ID NO: 8 - protein, 287 aa, Arabidopsis thaliana
MKSFVKPERDSLLRTVRIVFTDPDATDDSSSSSDEWLPKPRKVKRFVHEITFLPQVSESSQDRSNAVKTPRRKSTRQFKYPVGVRPRPSGKFAAEILNPFTKTKKWLGTYETPAEAEKAYVDKKVEYDALASSGSAVSSSVVTVTSQCLRSPTSASVSCVSADDLSKEKTSLNKDVAASGDSTTKEVFTTFDFSDVKIPDLRFLAAEEDSMVSNANGAELDFDCFLTDSNILLDDYSLLENDINFSRFENSLPSELPDCDFTEMEFQLDDFKFAYTDHLTTPPLGLV

SEQ ID NO: 9 - DNA, 1080 bp, Arabidopsis thaliana
  CDS (1)..(1080)
atgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttctattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtaaagtttggattcaagactcttttgtaaactaa

SEQ ID NO: 10 - protein, 359 aa, Arabidopsis thaliana
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLSIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGKVWIQDSFVN

SEQ ID NO: 11 - DNA, 1134 bp, Arabidopsis thaliana
  CDS (1)..(1134)
atggaatcggtggatcaatcatgtagtgttcctccgggattcagattccatccaacagatgaagagctcgttggttactatttaaggaaaaaagttgcatcgcaaaagatcgatcttgatgtcataagagatattgatctctacagaatcgaaccatgggatttacaagagagctgccgaatcggatatgaggaaagaaatgaatggtatttcttcagccacaaagataagaaatatccaacaggaacaagaacaaacagagcgaccatggctgggttttggaaagccacgggccgagacaaggctgtttacgacaagtcaaaactgattggtatgagaaaaacacttgtgttctacaaaggaagagcccctaatggccaaaaaaccgattggatcatgcatgaataccggctagagtcagatgagaatgcacctcctcaggaagaagggtgggtggtttgtagagcgttcaagaaaaagccaatgaccgggcaagccaagaacacagaaacttggagctcaagttacttttacgacgaattaccgagtggagtacgctcagttacggagcctcttaactacgtatctaagcagaaacaaaacgtttttgcacaagatttaatgttcaagcaagaactagaaggatcagatatcggtttaaacttcatccactgcgatcaattcattcaacttccgcagcttgaaagcccttcactccctcttaccaaaagaccagtgagcttgacgtcaattacatcattggagaagaataaaaatatctacaaaagacatttaatagaagaggatgtgagcttcaatgcgctaataagtagtggaaataaagataagaagaagaagaaaacatcagtgatgacgacggattggagagcactcgataaatttgttgcttctcaacttatgagccaagaagatggagtttcgggttttggaggtcatcatgaagaagataacaataaaatcggtcattacaataacgaagagagcaataacaagggatcagtagagactgcttcttccacgttattgagtgatagagaagaagagaacagattcatcagtggattattgtgttccaacttggactatgacttatatagggatttacatgtttga

SEQ ID NO: 12 - protein, 377 aa, Arabidopsis thaliana
MESVDQSCSVPPGFRFHPTDEELVGYYLRKKVASQKIDLDVIRDIDLYRIEPWDLQESCRIGYEERNEWYFFSHKDKKYPTGTRTNRATMAGFWKATGRDKAVYDKSKLIGMRKTLVFYKGRAPNGQKTDWIMHEYRLESDENAPPQEEGWVVCRAFKKKPMTGQAKNTETWSSSYFYDELPSGVRSVTEPLNYVSKQKQNVFAQDLMFKQELEGSDIGLNFIHCDQFIQLPQLESPSLPLTKRPVSLTSITSLEKNKNIYKRHLIEEDVSFNALISSGNKDKKKKKTSVMTTDWRALDKFVASQLMSQEDGVSGFGGHHEEDNNKIGHYNNEESNNKGSVETASSTLLSDREEENRFISGLLCSNLDYDLYRDLHV

SEQ ID NO: 13 - DNA, 1176 bp, Arabidopsis thaliana
  CDS (1)..(1176)
atgtgtgtcttaaaagtggcaaatcaggaagataacgttggcaaaaaagccgagtctattagagacgatgatcatcggacgttatctgaaatcgatcaatggctttacttattcgcagccgaagacgaccaccaccgtcatagcttccctacgcagcagccgcctccatcgtcgtcgtcctcatctcttatctcaggtttcagtagagagatggagatgtctgctattgtctctgctttgactcacgttgttgctggaaatgttcctcagcatcaacaaggaggcggtgaaggtagcggagaagggacttcgaattcgtcttcttcctcggggcagaaaaggaggagagaggtggaggaaggtggcgccaaagcggttaaggcagctaatactttgacggttgatcaatatttctccggtggtagctctacttctaaagtgagagaagcttcgagtaacatgtcaggtccgggcccaacatacgagtatacaactacggcaactgctagtagcgaaacgtcgtcgtttagtggggaccaacctcggcgaagatacagaggagttagacaaagaccatggggaaagtgggcggctgagattcgagatccatttaaagcagctagagtttggctcggtacgttcgacaatgctgaatcagcagcaagagcttacgacgaagctgcacttcggtttagaggcaacaaagccaaactcaacttccctgaaaacgtcaaactcgttagacctgcttcaaccgaagcacaacctgtgcaccaaaccgctgctcaaagaccgacccagtcaaggaactcgggttcaacgactacccttttgcccataagacctgcttcgaatcaaagcgttcattcgcagccgttgatgcaatcatacaacttgagttactctgaaatggctcgtcaacaacaacagtttcagcaacatcatcaacaatctttggatttatacgatcaaatgtcgtttccgttgcgtttcggtcacactggaggttcaatgatgcaatctacgtcgtcatcatcatctcattctcgtcctctgttttccccggctgctgttcagccgccaccagaatcagctagcgaaaccggttatctccaggatatacaatggccatcagacaagactagtaataactacaataatagtccatcctcctga

SEQ ID NO: 14 - protein, 391 aa, Arabidopsis thaliana
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 15 - DNA, 1374 bp, Arabidopsis thaliana
  CDS (1)..(1374)
atggtgaaagatctggttgggtatagattttatccaacgggagaggaattgataaaccattatctaaagaacaaaattttgggtaagacttggctcgtcgacgaagccattagcgagatcaacatctgtagttacgacccaatttacttgccttctttatcgaagataaaatcggatgatcctgtgtggtacttcttctgtccaaaggagtatacttctgcgaagaagaaggtaacgaagaggactacaagttcagggtattggaaagctactggtgttgataggaaaatcaaagataagagaggtaatcgcggcgagattgggataaagaagacgcttgtgtattatgaaggtagagttcctaaaggtgtttggactccttgggttatgcatgagtatcacatcacttgtttgcctcaagatcagaggaactatgttatctgccaagtgatgtataagggtgaagatggagacgtcccatctggtggtaacaactcgagtgagccgagtcaatctttggtctctgattcgaatactgtcagagctacgagtcccacagcgcttgagtttgagaagccaggtcaagaaaatttctttggtatgtctgtggatgatttggggactccaaagaatgaacaagaagatttctctttgtgggatgtactggatccagacatgttattcagtgacaataacaatcctactgtgcatccacaagctcctcacttaaccccgaatgatgatgagtttctcggtggattgaggcatgttaaccgagagcaggttgaatatttgtttgccaatgaagatttcatatccagaccaaccttatctatgaccgagaaccgcaacgatcacaggccaaagaaggctttgtcagggattattgttgattatagcagtgatagtaatagtgatgctgaatcgatatctgcaacgagttaccaaggaacatcaagtccaggtgatgatagtgttggtagttcgaatagacaatttctccagactggtggagatgagattctatcgtcttgcaatgatctacaaacctatggagaaccttccatcagtagtagcacccggcaatctcaactcacacgaagcatcatacgaccaaaacaagaggtgaaacaagatacatcaagagcggttgatagtgatacatccatagacaaggagtcatctatggtgaagacagagaagaagagctggtttattacagaggaagcaatggagagaaaccgcaacaatccacggtatatctatctcatgagaatgatcataggcttcattctcttgctggctctcattagcaacatcatatcggtgttacaaaacttgaacccggcgatgaagtttgatcgcgagagatag

SEQ ID NO: 16 - protein, 457 aa, Arabidopsis thaliana
MVKDLVGYRFYPTGEELINHYLKNKILGKTWLVDEAISEINICSYDPIYLPSLSKIKSDDPVWYFFCPKEYTSAKKKVTKRTTSSGYWKATGVDRKIKDKRGNRGEIGIKKTLVYYEGRVPKGVWTPWVMHEYHITCLPQDQRNYVICQVMYKGEDGDVPSGGNNSSEPSQSLVSDSNTVRATSPTALEFEKPGQENFFGMSVDDLGTPKNEQEDFSLWDVLDPDMLFSDNNNPTVHPQAPHLTPNDDEFLGGLRHVNREQVEYLFANEDFISRPTLSMTENRNDHRPKKALSGIIVDYSSDSNSDAESISATSYQGTSSPGDDSVGSSNRQFLQTGGDEILSSCNDLQTYGEPSISSSTRQSQLTRSIIRPKQEVKQDTSRAVDSDTSIDKESSMVKTEKKSWFITEEAMERNRNNPRYIYLMRMIIGFILLLALISNIISVLQNLNPAMKFDRER

SEQ ID NO: 17 - DNA, 756 bp, Arabidopsis thaliana
  CDS (1)..(756)
atgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttga

SEQ ID NO: 18 - protein, 251 aa, Arabidopsis thaliana
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 19 - DNA, 1470 bp, Arabidopsis thaliana
  CDS (1)..(1470)
atggggaaaactcaactcgctcctggatttcgtttccatccgactgatgttgaactcgtgaggtattacttgaagaggaaaatactggggaaaaagctccttgtcgatgctattgctgaagttgacatttacaagtttgaaccccctgatttacctgatatgtcttttataagaagtggggatcttaagtggcacttcttctgccccagggaaaagaagtatgctagtggggtaagggcaaaccgtgcaactgagtgtggctactggaagaccacggggaaggagagaccagttctgtgcaattctgaggttgtgggaaagatcaaaactctggtttatcactttggcaagtcgcctcgtggggagcggactgattgggttatgcatgaatacaggcttgacgacaaagtactgacgcagatgaatgttcctcaggatacttatgtggtgtgtgttctgttcaagaaagatggtcctggacctagaaatggagctcaatatggagctccgtttaaggaagaggactggagtgatgaggaagtacgtactgatgttccttctactagtaatcccacaaaccttcttgagcctagcaaagaaaccactctggctttgactgccccagatgactccaataaggattgttttggtggcatgatatcagagtcatgtgtctcggatttcctaccagctacaactaataccaccagcgagcttccacatccaagtgatgcagctaccactcctatgtctactgcacctctggcagagaccgttcagacccccaacaatgatgacttatattcaatgttggatctatttgatgatgacgaagagttcttagggttcaacaataatgaggtaagatatgatcccggtgtctcagctccagtttgcttagaagaagaaggcattttcaacggactaccagagttgagcagcatgccaaggacggcctcttacgacctagttgaaaactcggagttatacctagagctacaagacctcactgctccattaaatccccaaactgggctacaagacctcactgctccatttaatcctcaaactgggctacaagacctcactgctccatttaatcatcaaactgggctacaagaccacactgctccatttaatcctcaaactgggctacaagaccacactgctccatttaatcatcaaactgggctacaagacctcactgctccatttaatcctcaaactgggctacaagacctcactgctccatttaatcctcaaactgggctacatgacctcacttctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaa

SEQ ID NO: 20 - protein, 489 aa, Arabidopsis thaliana
MGKTQLAPGFRFHPTDVELVRYYLKRKILGKKLLVDAIAEVDIYKFEPPDLPDMSFIRSGDLKWHFFCPREKKYASGVRANRATECGYWKTTGKERPVLCNSEVVGKIKTLVYHFGKSPRGERTDWVMHEYRLDDKVLTQMNVPQDTYVVCVLFKKDGPGPRNGAQYGAPFKEEDWSDEEVRTDVPSTSNPTNLLEPSKETTLALTAPDDSNKDCFGGMISESCVSDFLPATTNTTSELPHPSDAATTPMSTAPLAETVQTPNNDDLYSMLDLFDDDEEFLGFNNNEVRYDPGVSAPVCLEEEGIFNGLPELSSMPRTASYDLVENSELYLELQDLTAPLNPQTGLQDLTAPFNPQTGLQDLTAPFNHQTGLQDHTAPFNPQTGLQDHTAPFNHQTGLQDLTAPFNPQTGLQDLTAPFNPQTGLHDLTSPFNPQTGLQDLTAPLNPQTGNRNDPRSSSFLYNQGHFDFSGGNDDDPYGFSASMRHRPKM

SEQ ID NO: 21 - DNA, 732 bp, Arabidopsis thaliana
  CDS (1)..(732)
atggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttga

SEQ ID NO: 22 - protein, 243 aa, Arabidopsis thaliana
MEYSQSSMYSSPSSWSSSQESLLWNESCFLDQSSEPQAFFCPNYDYSDDFFSFESPEMMIKEEIQNGDVSNSEEEEKVGIDEERSYRGVRKRPWGKFAAEIRDSTRNGIRVWLGTFDKAEEAALAYDQAAFATKGSLATLNFPVEVVRESLKKMENVNLHDGGSPVMALKRKHSLRNRPRGKKRSSSSSSSSSNSSSCSSSSSTSSTSRSSSKQSVVKQESGTLVVFEDLGAEYLEQLLMSSC

SEQ ID NO: 23 - DNA, 2373 bp, Arabidopsis thaliana
  CDS (1)..(2373)
atgtttgaagtcaaaatggggtcaaagatgtgcatgaacgcttcatgtggtacgacttctactgttgaatggaagaaaggttggcctcttcgatctggtcttctcgctgatctctgttatcgttgcggatctgcgtatgagagttctctattctgtgaacaatttcataaggaccaatctggttggagggaatgctatttgtgtagcaagagactacattgtggatgcattgcttctaaggtaacgattgagttaatggactatggtggtgttggttgtagtacatgtgcttgctgccatcaactcaatttgaacacaaggggtgagaatccaggtgtttttagcagattgccaatgaaaacgttagctgataggcaacatgtaaatggcgaaagcggaggaagaaacgaaggcgatctcttttctcagccactagtcatgggcggagataaaagggaagagttcatgcctcaccgtgggtttggtaagctaatgagtccagaaagtacaaccaccgggcataggctggatgctgctggggaaatgcatgaatcatcacctttacagccatctttaaatatgggtttggctgtgaatccgtttagcccatcttttgcaaccgaggctgtcgagggaatgaaacacatcagtccttctcagtccaacatggtccattgctctgcttctaatatactgcaaaagccatcaagacctgctatttcaactcctcctgtggctagtaaatccgctcaggcgcggattggaaggcctcctgtcgaagggcgagggagaggccacttgcttccgcggtattggccaaaatatacggataaagaggttcagcagatctctggaaatttgaatttgaacattgtacctctctttgagaaaactcttagtgccagtgatgctggtcgcattggtcgtctagttcttccaaaagcctgtgcagaggcatattttcctccgattagtcaatccgaaggcattcctttgaaaatccaagatgtgaggggtagggagtggacgttccagttcagatattggcccaataacaatagtagaatgtatgttttagaaggtgtcactccatgcatacagtccatgatgctacaggctggtgatacagtaactttcagtcgggttgatcctggcggaaaactaatcatgggttccaggaaggcagctaatgctggagacatgcagggttgtgggctcaccaacggaacatcaactgaggacacatcatcgtctggtgtaacagaaaacccaccctccataaatggttcctcgtgtatttcactaataccgaaagagttgaatggtatgcctgagaatttgaacagtgagactaacgggggcaggataggtgatgatcctacacgagttaaagagaagaagagaactcgaaccattggtgcaaaaaataagagacttcttttgcatagtgaagaatctatggagctgagactcacttgggaagaagctcaggacttgcttcgtccctctcctagtgtaaagcctaccatcgttgtcattgaggagcaagaaattgaagaatatgacgaacctcctgtctttggaaagaggactatagtcactacaaaaccttcaggtgaacaggaacgatgggcaacttgcgacgactgctctaaatggagaaggttacctgtagatgctcttctttcctttaaatggacatgtatagacaatgtttgggatgtgagtaggtgttcatgttctgcaccggaggagagtctgaaggaacttgagaatgttcttaaagtaggaagagagcacaagaagagaagaactggggaaagccaggcagcaaaaagtcagcaagaaccgtgtggtttggacgcactggcgagtgcagcagtcttaggagacacaataggcgagccagaggtagcgaccacgaccagacatccaaggcacagggctggatgctcttgcatcgtgtgcattcagccaccaagtgggaaaggtaggcacaagcctacatgtggctgcactgtgtgtagcaccgtgaagagaaggttcaagacgcttatgatgaggaggaagaagaagcagttggagcgcgatgtaacagcagcagaagataagaagaagaaggacatggaactggctgagtctgataagagtaaggaggagaaggaagtgaacacagcgagaatagacctgaacagtgatccatacaataaagaagatgttgaagctgttgcggtggagaaagaagagagtcgaaaaagagcaataggacagtgttcgggcgtggtggctcaagacgccagtgatgttttaggagttacagagttagaaggagagggtaagaatgttcgtgaagagccgagagtttcaagctga

SEQ ID NO: 24 - protein, 790 aa, Arabidopsis thaliana
MFEVKMGSKMCMNASCGTTSTVEWKKGWPLRSGLLADLCYRCGSAYESSLFCEQFHKDQSGWRECYLCSKRLHCGCIASKVTIELMDYGGVGCSTCACCHQLNLNTRGENPGVFSRLPMKTLADRQHVNGESGGRNEGDLFSQPLVMGGDKREEFMPHRGFGKLMSPESTTTGHRLDAAGEMHESSPLQPSLNMGLAVNPFSPSFATEAVEGMKHISPSQSNMVHCSASNILQKPSRPAISTPPVASKSAQARIGRPPVEGRGRGHLLPRYWPKYTDKEVQQISGNLNLNIVPLFEKTLSASDAGRIGRLVLPKACAEAYFPPISQSEGIPLKIQDVRGREWTFQFRYWPNNNSRMYVLEGVTPCIQSMMLQAGDTVTFSRVDPGGKLIMGSRKAANAGDMQGCGLTNGTSTEDTSSSGVTENPPSINGSSCISLIPKELNGMPENLNSETNGGRIGDDPTRVKEKKRTRTIGAKNKRLLLHSEESMELRLTWEEAQDLLRPSPSVKPTIVVIEEQEIEEYDEPPVFGKRTIVTTKPSGEQERWATCDDCSKWRRLPVDALLSFKWTCIDNVWDVSRCSCSAPEESLKELENVLKVGREHKKRRTGESQAAKSQQEPCGLDALASAAVLGDTIGEPEVATTTRHPRHRAGCSCIVCIQPPSGKGRHKPTCGCTVCSTVKRRFKTLMMRRKKKQLERDVTAAEDKKKKDMELAESDKSKEEKEVNTARIDLNSDPYNKEDVEAVAVEKEESRKRAIGQCSGVVAQDASDVLGVTELEGEGKNVREEPRVSS

SEQ ID NO: 25 - DNA, 831 bp, Arabidopsis thaliana
  CDS (1)..(831)
atgggaaaagatattgagctcccgggttttaggttccacccgactgaggaagagcttcttgatttctacctcaagaacatggtttacggtaagagatcgagtgtcgaagtcattggtttccttaacatataccgtcatgatccatgggacttacctggtttatcgagaatcggggagagggaatggtacttctttgtaccaagggaaaggaagcatgggaacggtgggaggccaagcaggacaactgaaaaaggatattggaaagcaactggatccgatcgtaaaatcataagcttgtctgagccaaaacgtgttatagggctcaagaagacgcttgtgttctatagaggaagagcaccaggaggaagcaagactgattgggtgatgaacgagtttcggatgcccgataattgctccttaccaaaggatgttgtgctttgtaagatatatagaaaagctacttcattgaaagtattggagcaaagggcagagatggaagctaagatgaatcaaacatgtcctaactctcctctttcgtcttccgagacgatttctttcgttggtaaagaagaaaacatgatgacttcgttccgtgctcctcaagtaatagctatggaagaagcaaacaagatccaaatgcatcaagaaaacgcgaaaaccgaagagaaacaaagagaagcagagaccaaagaaccttcttcatcactgaagctaccgtttggaagtttaccagagctacaattaccaaaaccaggagtagaatgggaccagttgttgagtataagcccatggctccagaatcttacaccaatagttaacatatattggtag

SEQ ID NO: 26 - protein, 276 aa, Arabidopsis thaliana
MGKDIELPGFRFHPTEEELLDFYLKNMVYGKRSSVEVIGFLNIYRHDPWDLPGLSRIGEREWYFFVPRERKHGNGGRPSRTTEKGYWKATGSDRKIISLSEPKRVIGLKKTLVFYRGRAPGGSKTDWVMNEFRMPDNCSLPKDVVLCKIYRKATSLKVLEQRAEMEAKMNQTCPNSPLSSSETISFVGKEENMMTSFRAPQVIAMEEANKIQMHQENAKTEEKQREAETKEPSSSLKLPFGSLPELQLPKPGVEWDQLLSISPWLQNLTPIVNIYW

SEQ ID NO: 27 - DNA, 1011 bp, Arabidopsis thaliana
  CDS (1)..(1011)
atgtcaagaaagccatgttgtgtgggagaaggactgaagaaaggagcatggactgccgaagaagacaagaaactcatctcttacattcatgaacacggtgaaggaggctggcgtgacattccccaaaaagctggactaaaacgatgtggaaagagttgtagattgcgatgggctaactatttgaaacctgacatcaagagaggagagtttagctatgaggaggaacagattatcatcatgctacacgcttctcgcggcaacaagtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacgatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattacgacgacaagaacttcatatga

SEQ ID NO: 28 - protein, 336 aa, Arabidopsis thaliana
MSRKPCCVGEGLKKGAWTAEEDKKLISYIHEHGEGGWRDIPQKAGLKRCGKSCRLRWANYLKPDIKRGEFSYEEEQIIIMLHASRGNKWSVIARHLPKRTDNEIKNYWNTHLKKLLIDKGIDPVTHKPLAYDSNPDEQSQSGSISPKSLPPSSSKNVPEITSSDETPKYDASLSSKKRCFKRSSSTSKLLNKVAARASSMGTILGASIEGTLISSTPLSSCLNDDFSETSQFQMEEFDPFYQSSEHIIDHMKEDISINNSEYDFSQFLEQFSNNEGEEADNTGGGYNQDLLMSDVSSTSVDEDEMMQNITGWSNYLLDHSDFNYDTSQDYDDKNFI

SEQ ID NO: 29 - DNA, 954 bp, Arabidopsis thaliana
  CDS (1)..(954)
atgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttga

SEQ ID NO: 30 - protein, 317 aa, Arabidopsis thaliana
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 31 - DNA, 339 bp, Arabidopsis thaliana
  CDS (1)..(339)
atggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaa

SEQ ID NO: 32 - protein, 112 aa, Arabidopsis thaliana
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 33 - DNA, 897 bp, Arabidopsis thaliana
  CDS (1)..(897)
atgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaagctgatattggatcaaagggcttattaaatgttagtagcccttctacatctggcatgggaagctcaagccgaacagtatcaggttctgagattgtaagaaaggctaaacagcctccagtgcttcacggtgttcctgattttgctgaagtttataatttcattgggagtgtctttgatcctgaaacgagaggccatgtggaaaagctcaaggaaatggatcctataaatttcgaaactgttctgttattgatgagaaacctcacagttaacttatcaaaccctgatttagaatccactaggaaagtcctcttatcatatgacaacgtgacgaccgagctcccaagcgttgtttcccttgtcaagaactcaacaagcgacaaatcagcataa

SEQ ID NO: 34 - protein, 298 aa, Arabidopsis thaliana
MSSSPSRNPTNAEAPPPPPTSTDAVAEGSSKKVRKPYTITKSRESWTEEEHDKFLEALQLFDRDWKKIEDFVGSKTVIQIRSHAQKYFLKVQKNGTLAHVPPPRPKRKAAHPYPQKASKNAQMPLQVSTSFTTTRNGDMPGYASWDDASMLLNRVISPQHELATLRGAEADIGSKGLLNVSSPSTSGMGSSSRTVSGSEIVRKAKQPPVLHGVPDFAEVYNFIGSVFDPETRGHVEKLKEMDPINFETVLLLMRNLTVNLSNPDLESTRKVLLSYDNVTTELPSVVSLVKNSTSDKSA

SEQ ID NO: 35 - DNA, 945 bp, Arabidopsis thaliana
  CDS (1)..(945)
atggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtga

SEQ ID NO: 36 - protein, 314 aa, Arabidopsis thaliana
MADLFGGGHGGELMEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 37 - DNA, 579 bp, Arabidopsis thaliana
  CDS (1)..(579)
atgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtga

SEQ ID NO: 38 - protein, 192 aa, Arabidopsis thaliana
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 39 - DNA, 1350 bp, Arabidopsis thaliana
  CDS (1)..(1350)
atggctgggcgatcatggctgatcgatagcaaccggattgcaacgaagattatgagtgcatcggctagttccgatcctcgccaagtggtgtggaagagcaacccgtcaagacattgtcccaagtgtcaacatgtcattgacaacagtgatgttgttgatgattggccaggattgcctcgaggtgtgaaatttgatccatctgatcctgagatcatatggcatttgctagccaaatctggtttgtcagggttaagctcacaccctttcattgatgagttcatcccaaccgtcaatcaagatgatggaatctgttacactcatcctaagaatttaccaggtgttaagagtgatgggacggtgtctcacttcttccataaagcaatcaaagcttatagcacaggaactcgaaagcgtagaaagattcacgacgatgattttggcgatgtgcgctggcataagacaggaagaacgaaaccggttgtgttggatggtgttcaaagaggttgcaagaagataatggttctctatggcggaaaagctgtgaaaaccaactgggtgatgcaccaataccatttgggaatagaagaagacgagaaggaaggtgattatgttgtttctaagattttctaccagcagccacaacagctagtagtcaagcgaggtgataaagctgaacaggaagtctctgaggatatctttgctgcagtgactccaacagcggatcctgtcactccaaaattagctacacctgagcctcgaaatgctgtgcgaatttgctctgattctcacattgccagtgactatgttactcccagtgactatgtatctgcccatgaggtttctcttgccgagacatccgaggtaatgtgtatggaagatgaggttcagagtattcaacctaatcatgaaagaccaagttctgggcctgagctggagcacggacttgaaaacggagcaaaagaaatgttagatgataaagaggagcaagagaaggatagagacaatgaaaaccaaggtgaggaagatccgacgtggtttgacagtggatctcagtttatcttgaattcgcaacagcttgtggaagccttgtctctttgcgacgatctcttgggatcacaggacagggaggaaaacacaaacagtggaagcttaaaggataaacaaccatgtattgcggattacgcacacctaggaccagaagacttcaaacgtgatctggaggaatgtcagaaaatcgttcttgatccctctaacatagagcttgatactccacctgagtttcgtctgagccagctggaatttggatcacaggacagctttctcgcttgggggactggaaagactgattga

SEQ ID NO: 40 - protein, 449 aa, Arabidopsis thaliana
MAGRSWLIDSNRIATKIMSASASSDPRQVVWKSNPSRHCPKCQHVIDNSDVVDDWPGLPRGVKFDPSDPEIIWHLLAKSGLSGLSSHPFIDEFIPTVNQDDGICYTHPKNLPGVKSDGTVSHFFHKAIKAYSTGTRKRRKIHDDDFGDVRWHKTGRTKPVVLDGVQRGCKKIMVLYGGKAVKTNWVMHQYHLGIEEDEKEGDYVVSKIFYQQPQQLVVKRGDKAEQEVSEDIFAAVTPTADPVTPKLATPEPRNAVRICSDSHIASDYVTPSDYVSAHEVSLAETSEVMCMEDEVQSIQPNHERPSSGPELEHGLENGAKEMLDDKEEQEKDRDNENQGEEDPTWFDSGSQFILNSQQLVEALSLCDDLLGSQDREENTNSGSLKDKQPCIADYAHLGPEDFKRDLEECQKIVLDPSNIELDTPPEFRLSQLEFGSQDSFLAWGTGKTD

SEQ ID NO: 41 - DNA, 1887 bp, Arabidopsis thaliana
  CDS (1)..(1887)
atgatgtttaatgagatgggaatgtgtggaaacatggatttcttctcttctggatcacttggtgaagttgatttctgtcctgttccacaagctgagcctgattccattgttgaagatgactatactgatgatgagattgatgttgatgaattggagaggaggatgtggagagacaaaatgcggcttaaacgtctcaaggagcaggataagggtaaagaaggtgttgatgctgctaaacagaggcagtctcaagagcaagctaggaggaagaaaatgtctagagctcaagatgggatcttgaagtatatgttgaagatgatggaagtttgtaaagctcaaggctttgtttatgggattattccggagaatgggaagcctgtgactggtgcttctgataatttaagggagtggtggaaagataaggttaggtttgatcgtaatggtcctgcggctattaccaagtatcaagcggagaataatatcccggggattcatgaaggtaataacccgattggaccgactcctcataccttgcaagagcttcaagacacgactcttggatcgcttttgtctgcgttgatgcaacactgtgatcctcctcagagacgttttcctttggagaaaggagttcctcctccgtggtggcctaatgggaaagaggattggtggcctcaacttggtttgcctaaagatcaaggtcctgcaccttacaagaagcctcatgatttgaagaaggcgtggaaagtcggcgttttgactgcggttatcaagcatatgtttcctgatattgctaagatccgtaagctcgtgaggcaatctaaatgtttgcaggataagatgactgctaaagagagtgctacctggcttgctattattaaccaagaagagtccttggctagagagctttatcccgagtcatgtccacctctttctctgtctggtggaagttgctcgcttctgatgaatgattgcagtcaatacgatgttgaaggtttcgagaaggagtctcactatgaagtggaagagctcaagccagaaaaagttatgaattcttcaaactttgggatggttgctaaaatgcatgactttcctgtcaaagaagaagtcccagcaggaaactcggaattcatgagaaagagaaagccaaacagagatctgaacactattatggacagaaccgttttcacctgcgagaatcttgggtgtgcgcacagcgaaatcagccggggatttctggataggaattcgagagacaaccatcaactggcatgtccacatcgagacagtcgcttaccgtatggagcagcaccatccaggtttcatgtcaatgaagttaagcctgtagttggatttcctcagccaaggccagtgaactcagtagcccaaccaattgacttaacgggtatagttcctgaagatggacagaagatgatctcagagctcatgtccatgtacgacagaaatgtccagagcaaccaaacctctatggtcatggaaaatcaaagcgtgtcactgcttcaacccacagtccataaccatcaagaacatctccagttcccaggaaacatggtggaaggaagtttctttgaagacttgaacatcccaaacagagcaaacaacaacaacagcagcaacaatcaaacgttttttcaagggaacaacaacaacaacaatgtgtttaagttcgacactgcagatcacaacaactttgaagctgcacataacaacaacaataacagtagcggcaacaggttccagcttgtgtttgattccacaccgttcgacatggcgtcattcgattacagagatgatatgtcgatgccaggagtagtaggaacgatggatggaatgcagcagaagcagcaagatgtatccatatggttctaa

SEQ ID NO: 42 - protein, 628 aa, Arabidopsis thaliana
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 43 - DNA, 660 bp, Arabidopsis thaliana
  CDS (1)..(660)
atgttgaaatcaagtaacaagagaaaaagcaaagaagagaagaagttacaagaagggaagtaccttggagtgaggagacgtccatggggaagatatgcagctgaaatcagaaacccttttactaaagaaagacattggcttggaacgtttgatacagccgaagaagctgcttttgcatatgacgttgctgctcgatccatcagcggctctctagctacaacaaacttcttctacactgaaaacacctctttagaaagacatccacaacagtctttggagcctcatatgacttggggatcttctagtctctgtcttcttcaagatcagccttttgaaaacaaccattttgttgctgatcctatctcttcttctttttctcaaaaacaagagtcttctaccaatctcactaacactttctcacattgttataatgatggtgatcatgttggccaaagcaaagagatttctttacctaatgatatgtcaaacagtttattcggtcatcaggacaaagtcggtgaacatgacaatgcagaccatatgaagtttggctcagttctcagcgacgaacctctctgctttgagtatgactacattgggaattatcttcagagttttctcaaagatgtcaacgacgatgctccacagtttcttatgtga

SEQ ID NO: 44 - protein, 219 aa, Arabidopsis thaliana
MLKSSNKRKSKEEKKLQEGKYLGVRRRPWGRYAAEIRNPFTKERHWLGTFDTAEEAAFAYDVAARSISGSLATTNFFYTENTSLERHPQQSLEPHMTWGSSSLCLLQDQPFENNHFVADPISSSFSQKQESSTNLTNTFSHCYNDGDHVGQSKEISLPNDMSNSLFGHQDKVGEHDNADHMKFGSVLSDEPLCFEYDYIGNYLQSFLKDVNDDAPQFLM

SEQ ID NO: 45 - DNA, 1098 bp, Arabidopsis thaliana
  CDS (1)..(1098)
atggagccaatggaatcttgtagcgttcctccaggatttaggttccatccgacggacgaagagcttgtcgggtactatctaaggaagaaaatcgcatcgcaaaagattgatctcgacgtcatcagagacatcgatctctacagaatagaaccatgggatctacaagaacaatgtcgaatcggttatgaggaacaaaatgaatggtatttttttagtcacaaggacaagaaatatccaacggggacaagaactaatagagcgaccatggctggattttggaaagccacgggaagagacaaagctgtttacgacaaaacaaaactaattggtatgaggaaaacacttgtgttctacaaaggacgtgcacctaatggcaagaaatccgattggatcatgcatgagtaccggctcgagtcagatgagaatgcaccgccccaggaagaaggatgggtggtttgtagagcattcaaaaaaagagctacagggcaagccaagaacacggaaacttggagctcaagttacttttacgatgaagttgcaccgaatggagttaactcggttatggaccccattgattacatatctaagcagcaacataacatttttgggaaaggtttgatgtgtaagcaagaactagaaggaatggttgatggtataaactatatacaatcgaatcaattcattcagctcccacaactccaaagcccttctctcccgctgatgaaaagaccttcaagctcgatgtccataacatcaatggataacaattacaactataaactcccattagcggatgaagaaagcttcgagtcattcataagaggagaggatagaaggaagaagaaaaagcaagtaatgatgacgggaaattggagagagttagacaagtttgttgcttcacaacttatgagccaagaagacaatggaacttcaagtttcgcaggtcatcatatagttaatgaagataaaaacaacaatgatgtggagatggattcgtcaatgtttttgagcgaaagagaagaagaaaacaggttcgtcagtgaattcttgagtacaaactcggattatgatattgggatttgcgtatttgataattga

SEQ ID NO: 46 - protein, 365 aa, Arabidopsis thaliana
MEPMESCSVPPGFRFHPTDEELVGYYLRKKIASQKIDLDVIRDIDLYRIEPWDLQEQCRIGYEEQNEWYFFSHKDKKYPTGTRTNRATMAGFWKATGRDKAVYDKTKLIGMRKTLVFYKGRAPNGKKSDWIMHEYRLESDENAPPQEEGWVVCRAFKKRATGQAKNTETWSSSYFYDEVAPNGVNSVMDPIDYISKQQHNIFGKGLMCKQELEGMVDGINYIQSNQFIQLPQLQSPSLPLMKRPSSSMSITSMDNNYNYKLPLADEESFESFIRGEDRRKKKKQVMMTGNWRELDKFVASQLMSQEDNGTSSFAGHHIVNEDKNNNDVEMDSSMFLSEREEENRFVSEFLSTNSDYDIGICVFDN

SEQ ID NO: 47 - DNA, 1098 bp, Arabidopsis thaliana
  CDS (1)..(1098)
atgattggagatctaatgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactga

SEQ ID NO: 48 - protein, 365 aa, Arabidopsis thaliana
MIGDLMKNNNNGDVVDNEVNNRLSRWHHNSSRIIRVSRASGGKDRHSKVLTSKGPRDRRVRLSVSTALQFYDLQDRLGYDQPSKAVEWLIKAAEDSISELPSLNNTHFPTDDENHQNQTLTTVAANSLSKSACSSNSDTSKNSSGLSLSRSELRDKARERARERTAKETKERDHNHTSFTDLLNSGSDPVNSNRQWMASAPSSSPMEYFSSGLILGSGQQTHFPISTNSHPFSSISDHHHHHPHHQHQEFSFVPDHLISPAESNGGAFNLDFNMSTPSGAGAAVSAASGGGFSGFNRGTLQSNSTNQHQSFLANLQRFPTSESGGGPQFLFGALPAENHHHNHQFQLYYENGCRNSSEHKGKGKN

SEQ ID NO: 49 - DNA, 729 bp, Arabidopsis thaliana
  CDS (1)..(729)
atgggaataaaaaaagaagatcagaaaagttccttgtccttgttgacgcaacgatggaataatccgaggatcgtgcgagtctcccgagcatttggaggcaaagatagacacagcaaagtgtgcacagttcgtggtctccgagacaggaggataaggttgtcggtgatgacagcgatccaagtctacgaccttcaagaacgattagggctgagtcagcctagcaaagtcattgattggctcttagaagttgccaaaaacgacgtcgatttgcttcctcctttgcaattcccacctggttttcaccaacttaaccctaatctcaccggccttggagaatcttttcccggggtcttcgatcttggaagaacacagagagaagctttggatcttgagaaaaggaaatgggttaatcttgatcatgtgtttgatcacatcgatcatcacaaccatttctcgaattcaatccagagcaacaagctttatttccctacaattacttcgtctagcagctcttatcactacaaccttggacatctccaacagtcactactagaccaatctggtaacgtcactgtcgcattttctaataactataataataataatctcaatcctccggcggcggaaactatgagttctctattcccaacaaggtacccttcgtttctcggtggtggtcaacttcaactctttagtagcacaagctcacaaccagaccatatcgagtag

SEQ ID NO: 50 - protein, 242 aa, Arabidopsis thaliana
MGIKKEDQKSSLSLLTQRWNNPRIVRVSRAFGGKDRHSKVCTVRGLRDRRIRLSVMTAIQVYDLQERLGLSQPSKVIDWLLEVAKNDVDLLPPLQFPPGFHQLNPNLTGLGESFPGVFDLGRTQREALDLEKRKWVNLDHVFDHIDHHNHFSNSIQSNKLYFPTITSSSSSYHYNLGHLQQSLLDQSGNVTVAFSNNYNNNNLNPPAAETMSSLFPTRYPSFLGGGQLQLFSSTSSQPDHIE

SEQ ID NO: 51 - DNA, 2430 bp, Arabidopsis thaliana
  CDS (1)..(2430)
atggatgttatggctttgttaacagctttagtttgtgcacaaggtaggaacgaggctactactaatgggtctccgggagtgcctcaaagagagcaacttcttcagatacttaacaagatcaaggctttacctttgcctatgaatcttacctcgaagttgaacaatatcggaattttagccaggaaaaatccggagcaaccctccccgatgaatcctcaaaatagtatgaatggggcttcttctccatctacgatggacttgcttgctgctctctcggcatctttaggttcatctgctccagaggccatagcttttttatctcaaggagggtttggtaacaaagaaagcaatgataggactaagttaacttcttctgaccacagcgccacaaccagtttagaaaagaaaactttggagtttccttcttttgggggaggagagaggacaagtagcactaaccattctccatctcagtattcagattcacgcggtcaagacactagatcgagcttatctctacaactattcacctcttcaccagaagaggagagtcgaccaaaagttgcatcttcaacaaagtattattcttctgcgagcagtaaccctgttgaggatagatcaccatcatcatctccagtcatgcaagagttattccctttgcatacttctcctgaaaccaggaggtataacaattacaaagacactagtaccagtcccaggaccagttgtttgcccctagagctctttggtgcatcaaatagaggagctactgcaaatcctaattacaatgttttgaggcatcaatctggttatgcttcatctggttcggattattctcctcctagcttaaactctaatgctcaggagcgcacaggaaagatatctttcaaactatttgaaaaagatcctagtcagctccctaacacattgcgaaccgagatctttagatggctttctagttttccatcagatatggagagttttatcaggcctggttgtgttattttatctgtctatgtggcaatgtcagcttctgcttgggaacaacttgaggaaaatttactgcaacgagttagatctttggttcaagattcagaattttggagtaattcaagatttttggtcaatgcaggcagacagctcgcgtcacacaaacatggtagaattcgtctgagcaaatcttggagaactttgaatttaccagagctaatcacggtgtcgccgttggctgttgtagccggtgaagaaacagctttaatagtaaggggtagaaacttgactaatgacggaatgagacttcgttgcgcacatatgggtaactacgcgtcaatggaggtaactggaagagaacataggttaacaaaagttgatgagttaaacgtaagtagtttccaagtccagagtgcaagctctgtttctctaggacgatgtttcattgagttggagaatggattaagaggtgacaatttccctttgataatagccaatgccacgatttgcaaagagttgaatcgccttgaagaagagtttcatccaaaagacgtgatagaggaacaaatacagaacttagatcgtccaagatcaagagaagaagttctttgcttcttgaatgagcttggttggctatttcagaggaaatggacatccgatattcatggagaacccgacttttctcttcctcgcttcaaatttttgctcgtatgctctgttgaaagagattactgttctctcataagaaccgtcctggatatgatggtagagagaaatttgggaaaagacggtctgttgaacaaggagtccttagatatgctggctgatattcagctactgaatcgcgctatcaaaaggagaaacacaaaaatggctgaaactctgatccattattccgttaatccctctactagaaacttcatcttcttgcctagtatcgctggacctggcgatatcacacctttgcatttggctgcttccacatctagttctgatgatatgattgatgccctgactaatgatccacaagagattggattatcttgctggaataccctagtcgatgcaaccgggcaaactccctttagctacgctgcaatgagagacaaccacagttacaacaccttggtggctcgtaaacttgcagataaaagaaacggtcaaatatctctgaacattgaaaatgggatcgatcagattggcctgagtaagagactaagctcagagctaaagagatcttgcaacacatgtgcaagtgtggctctaaagtatcagaggaaggtttcgggttcacgtcgattgttcccaactccgatcattcactcgatgcttgcggttgcgacagtatgtgtttgcgtctgcgtgtttatgcatgctttcccaatggtcagacaaggctctcacttcagttggggtggtcttgattatggctcaatctaa

SEQ ID NO: 52 - protein, 809 aa, Arabidopsis thaliana
MDVMALLTALVCAQGRNEATTNGSPGVPQREQLLQILNKIKALPLPMNLTSKLNNIGILARKNPEQPSPMNPQNSMNGASSPSTMDLLAALSASLGSSAPEAIAFLSQGGFGNKESNDRTKLTSSDHSATTSLEKKTLEFPSFGGGERTSSTNHSPSQYSDSRGQDTRSSLSLQLFTSSPEEESRPKVASSTKYYSSASSNPVEDRSPSSSPVMQELFPLHTSPETRRYNNYKDTSTSPRTSCLPLELFGASNRGATANPNYNVLRHQSGYASSGSDYSPPSLNSNAQERTGKISFKLFEKDPSQLPNTLRTEIFRWLSSFPSDMESFIRPGCVILSVYVAMSASAWEQLEENLLQRVRSLVQDSEFWSNSRFLVNAGRQLASHKHGRIRLSKSWRTLNLPELITVSPLAVVAGEETALIVRGRNLTNDGMRLRCAHMGNYASMEVTGREHRLTKVDELNVSSFQVQSASSVSLGRCFIELENGLRGDNFPLIIANATICKELNRLEEEFHPKDVIEEQIQNLDRPRSREEVLCFLNELGWLFQRKWTSDIHGEPDFSLPRFKFLLVCSVERDYCSLIRTVLDMMVERNLGKDGLLNKESLDMLADIQLLNRAIKRRNTKMAETLIHYSVNPSTRNFIFLPSIAGPGDITPLHLAASTSSSDDMIDALTNDPQEIGLSCWNTLVDATGQTPFSYAAMRDNHSYNTLVARKLADKRNGQISLNIENGIDQIGLSKRLSSELKRSCNTCASVALKYQRKVSGSRRLFPTPIIHSMLAVATVCVCVCVFMHAFPMVRQGSHFSWGGLDYGSI

SEQ ID NO: 53 - DNA, 879 bp, Arabidopsis thaliana
  CDS (1)..(879)
atggactttgacgaggagctaaatctttgtattacgaaaggtaaaaatgttgatcattcttttggaggagaagcttcttccacgtccccaagatctatgaagaaaatgaagagtcctagtcgtcctaaaccctatttccaatcctcttcttctccttattcgttagaggctttccctttttctctcgatccaacacttcagaatcagcaacaacaactcggatcatacgttccggtacttgagcaacgacaagacccgacaatgcaaggccagaagcaaatgatctcctttagtcctcaacaacaacaacagcagcagcagtatatggcccagtactggagtgacacattgaatctgagtccaagaggaagaatgatgatgatgatgagccaagaagctgttcaaccttacatcgcaacgaagctgtacagaggagtgagacaacgtcaatggggaaaatgggtcgcagagatccgtaagccacgaagcagggcacgtctttggcttggtacctttgatacagctgaagaagctgccatggcctacgaccgccaagccttcaaattacgaggccacagcgcaacactgaatttcccggagcattttgtgaataaggaaagcgagctgcatgattcaaactcgtcggatcagaaagaacctgaaacgccacagccaagcgaggttaacttggagagcaaggaactaccggtgattgatgttgggagagaggaaggtatggctgaggcatggtacaatgccattacatcgggatggggtcctgaaagtcctctttgggatgatttggatagttctcatcagttttcatcagaaagctcatcttcttctcctctctcttgtcctatgaggcctttcttttga

SEQ ID NO: 54 - protein, 292 aa, Arabidopsis thaliana
MDFDEELNLCITKGKNVDHSFGGEASSTSPRSMKKMKSPSRPKPYFQSSSSPYSLEAFPFSLDPTLQNQQQQLGSYVPVLEQRQDPTMQGQKQMISFSPQQQQQQQQYMAQYWSDTLNLSPRGRMMMMMSQEAVQPYIATKLYRGVRQRQWGKWVAEIRKPRSRARLWLGTFDTAEEAAMAYDRQAFKLRGHSATLNFPEHFVNKESELHDSNSSDQKEPETPQPSEVNLESKELPVIDVGREEGMAEAWYNAITSGWGPESPLWDDLDSSHQFSSESSSSSPLSCPMRPFF

SEQ ID NO: 55 - DNA, 1083 bp, Arabidopsis thaliana
  CDS (1)..(1083)
atgagatcaggagaatgtgatgaagaggagattcaagcaaagcaagaaagagatcaaaatcaaaatcatcaagtaaacttaaaccacatgttgcaacaacaacagccgagttcggtatcatcttcaaggcaatggacttcagcttttaggaatccaagaatcgttcgagtctcaagaacattcggtggcaaagacagacacagcaaagtatgtacagtccgtggtcttcgagaccggaggataaggttgtccgtacctacagctattcaactctacgaccttcaagatcgattagggctgagtcagccaagcaaagtcattgattggttactcgaagcagcaaaagatgacgtagacaagctacctcctctacaattcccacatggatttaaccagatgtatccaaatctcatcttcggaaactccgggtttggagaatctccatcttcaactacatcaacaacgtttccaggaaccaatctcgggttcttggaaaattgggatcttggtggttcttcaagaacaagagcaagattaaccgatacaactacgacccaaagagaaagttttgatcttgataaaggaaaatggatcaaaaacgacgagaatagtaatcaagatcatcaagggtttaacaccaatcatcaacaacaatttcctctgaccaatccgtacaacaacacttcagcttattacaaccttggacatcttcaacaatcgttagaccaatctggtaataacgttactgtcgcaatatctaatgttgctgctaataataacaataatctcaatttgcatcctccttcctcgtctgccggagatggatctcagctttttttcggtcctactcctccggcaatgagctctctattcccgacatacccttcgtttcttggagcttctcatcatcatcatgtcgtcgatggagccggtcatcttcagctctttagctcgaattcaaataccgcatcgcagcaacacatgatgccgggtaatacgagtttgattagaccatttcatcatttgatgagctcgaatcatgatacggatcatcatagtagcgataatgaatcagattcttga

SEQ ID NO: 56 - protein, 360 aa, Arabidopsis thaliana
MRSGECDEEEIQAKQERDQNQNHQVNLNHMLQQQQPSSVSSSRQWTSAFRNPRIVRVSRTFGGKDRHSKVCTVRGLRDRRIRLSVPTAIQLYDLQDRLGLSQPSKVIDWLLEAAKDDVDKLPPLQFPHGFNQMYPNLIFGNSGFGESPSSTTSTTFPGTNLGFLENWDLGGSSRTRARLTDTTTTQRESFDLDKGKWIKNDENSNQDHQGFNTNHQQQFPLTNPYNNTSAYYNLGHLQQSLDQSGNNVTVAISNVAANNNNNLNLHPPSSSAGDGSQLFFGPTPPAMSSLFPTYPSFLGASHHHHVVDGAGHLQLFSSNSNTASQQHMMPGNTSLIRPFHHLMSSNHDTDHHSSDNESDS

SEQ ID NO: 57 - DNA, 747 bp, Arabidopsis thaliana
  CDS (1)..(747)
atggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggtaaaagaaatcgagctgcaaaacgataacatgtatctccgctccaagattactgaaagaacaggtctacagcaacaagaatcgagtgtgatacatcaagggacagtttacgagtcgggtgttacttcttctcaccagtcggggcagtataaccggaattatattgcggttaaccttcttgaaccgaatcagaattcctccaaccaagaccaaccacctctgcaacttgtttga

SEQ ID NO: 58 - protein, 248 aa, Arabidopsis thaliana
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKRVKEIELQNDNMYLRSKITERTGLQQQESSVIHQGTVYESGVTSSHQSGQYNRNYIAVNLLEPNQNSSNQDQPPLQLV

SEQ ID NO: 59 - DNA, 975 bp, Arabidopsis thaliana
  CDS (1)..(975)
atggaggttgacgaagacattgagttacaaaaacatcaagaacaacaaagcagaaagctacaaagattctcagaggacaacactggactaatgaggaattggaacaatccatcgtctcgtatcattagggtttcacgagcttctggtggcaaagatagacatagcaaagtgttaacatcaaaaggtttaagagatcgaagaatacgtctctcagttgctacagcaatccagttctatgatcttcaagatcgtcttggatttgatcagccaagtaaagctgttgaatggttaatcaatgcagcttctgattcaatcactgatcttcctttgcttaacacaaattttgatcatcttgatcagaatcagaatcagaccaaatctgcttgtagtagtggaacatctgagagttcgctgttgtcgttatcaagaacagagattcgtgggaaagcaagagagagagctagagaaagaacagctaaagacagagataaagatttgcagaatgctcatagctcattcactcagcttctcactggtggttttgaccaacaaccgagtaaccggaattggaccggtggttctgattgctttaacccggttcagctgcaaataccaaactcttcctctcaagagccaatgaatcacccattctcctttgtacctgattacaactttggaatctcttcttcttcttctgccattaatggtggttacagtagtagggggacccttcagtccaattcacaatctctctttctgaataacaacaacaacattactcaaaggtcatcgatttcttcgtcttcttcttcctcttctccaatggatagtcaaagcatttcctttttcatggctacacctccacctcttgaccaccataaccaccagcttccggagacttttgatggtcggctatatctttattacggcgaaggaaaccggagctctgatgacaaggcaaaggaaaggagatag

SEQ ID NO: 60 - protein, 324 aa, Arabidopsis thaliana
MEVDEDIELQKHQEQQSRKLQRFSEDNTGLMRNWNNPSSRIIRVSRASGGKDRHSKVLTSKGLRDRRIRLSVATAIQFYDLQDRLGFDQPSKAVEWLINAASDSITDLPLLNTNFDHLDQNQNQTKSACSSGTSESSLLSLSRTEIRGKARERARERTAKDRDKDLQNAHSSFTQLLTGGFDQQPSNRNWTGGSDCFNPVQLQIPNSSSQEPMNHPFSFVPDYNFGISSSSSAINGGYSSRGTLQSNSQSLFLNNNNNITQRSSISSSSSSSSPMDSQSISFFMATPPPLDHHNHQLPETFDGRLYLYYGEGNRSSDDKAKERR

SEQ ID NO: 61 - DNA, 552 bp, Arabidopsis thaliana
  CDS (1)..(552)
atggctggtcttaggaattccggtaacagcgacaaagcgcaaaacgatggcaaaggtgtaccatctgcctacagaggagtccggaagagaaaatgggggaaatgggtgtctgaaatccgtgaaccggggaccaagaaccgtatctggctaggcagtttcgagactcctgaaatggctgcaaccgcatacgacgtggcagcatttcatttcagagggagagaagctcgtctcaacttccctgagctcgccagcagccttccacgtcctgcagactctagctcagacagcattcgcatggcagttcatgaggcaacactctgccgcaccaccgaaggaacagagtcagccatgcaagtggacagctcaagctcctccaatgtagctccaacaatggtcagactctcgcccagggaaattcaagcgatcaacgagtcaactttgggatctcctactacaatgatgcattcaacatacgaccctatggagtttgctaatgatgtggagatgaatgcttgggaaacataccagagtgactttctttgggacccttaa

SEQ ID NO: 62 - protein, 183 aa, Arabidopsis thaliana
MAGLRNSGNSDKAQNDGKGVPSAYRGVRKRKWGKWVSEIREPGTKNRIWLGSFETPEMAATAYDVAAFHFRGREARLNFPELASSLPRPADSSSDSIRMAVHEATLCRTTEGTESAMQVDSSSSSNVAPTMVRLSPREIQAINESTLGSPTTMMHSTYDPMEFANDVEMNAWETYQSDFLWDP

SEQ ID NO: 63 - DNA, 1101 bp, Arabidopsis thaliana
  CDS (1)..(1101)
atggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagttgagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttag

SEQ ID NO: 64 - protein, 366 aa, Arabidopsis thaliana
MGRHSCCYKQKLRKGLWSPEEDEKLLTHITNHGHGCWSSVPKLAGLQRCGKSCRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 65 - DNA, 1356 bp, Arabidopsis thaliana
  CDS (1)..(1356)
atgggtcgcgaatctgtggctgttgtgactgcgccgccctcggcgactgctccgggtactgcttcggtggcgacctcgcttgctcctggcttccgatttcatccgactgatgaggaactcgtgagctattacttgaagaggaaggttctgggccaacctgtacgcttcgatgcgattggagaggtcgatatatacaagcatgagccctgggatttagcagtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtgcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataa

SEQ ID NO: 66 - protein, 451 aa, Arabidopsis thaliana
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 67 - DNA, 1185 bp, Arabidopsis thaliana
  CDS (1)..(1185)
atgaattcgttttcacaagtacctcctggcttcagatttcatcctactgatgaagaacttgtagactactacttgaggaaaaaagttgcatcaaagagaatagaaatcgatatcatcaaggatgttgatctttacaagattgagccatgtgatcttcaagagttatgcaagataggaaacgaagagcagagcgaatggtacttctttagtcataaagacaagaagtatcccacgggaactcgaaccaatagagccacgaaagcaggattttggaaagccactggaagagacaaggctatatatataagacatagtcttatcggtatgaggaaaacacttgtgttttacaaaggaagagccccaaatggtcagaaatccgattggatcatgcacgaatatcgcttagaaacaagtgaaaatggaacccctcaggaagaaggatgggtagtatgtagggtattcaagaagaaattggcagcgacagtgaggaaaatgggagattaccattcatcaccatcgcagcattggtacgatgatcagctctcttttatggcctccgagatcatttctagttctccacgacagtttcttcccaatcatcattataaccgccaccatcaccagcagacattgccttgtggcctcaatgcattcaacaacaacaatcctaacttgcaatgcaagcaagagctcgagttacattacaatcaaatggtacaacatcaacaacaaaaccatcatcttcgtgaatctatgtttctccagcttcctcagctcgaaagccctaccagtaattgcaattctgacaacaacaataacacaagaaatattagtaacttgcagaaatcatcaaatatatctcatgaggaacaattgcaacaagggaatcaaagtttcagctctctgtattacgatcaaggagtagagcaaatgactactgactggagagttctcgataaatttgttgcttcacagcttagcaatgatgaagaggctgcagccgtggtttcttcttcttctcatcaaaacaacgtcaagattgacacgagaaacacgggttatcatgtgatagatgagggaataaatttgccggagaatgattctgaaagggttgttgaaatgggagaagagtattcaaatgctcatgctgcttctacttcttcaagttgtcagattgatctctag

SEQ ID NO: 68 - protein, 394 aa, Arabidopsis thaliana
MNSFSQVPPGFRFHPTDEELVDYYLRKKVASKRIEIDIIKDVDLYKIEPCDLQELCKIGNEEQSEWYFFSHKDKKYPTGTRTNRATKAGFWKATGRDKAIYIRHSLIGMRKTLVFYKGRAPNGQKSDWIMHEYRLETSENGTPQEEGWVVCRVFKKKLAATVRKMGDYHSSPSQHWYDDQLSFMASEIISSSPRQFLPNHHYNRHHHQQTLPCGLNAFNNNNPNLQCKQELELHYNQMVQHQQQNHHLRESMFLQLPQLESPTSNCNSDNNNNTRNISNLQKSSNISHEEQLQQGNQSFSSLYYDQGVEQMTTDWRVLDKFVASQLSNDEEAAAVVSSSSHQNNVKIDTRNTGYHVIDEGINLPENDSERVVEMGEEYSNAHAASTSSSCQIDL

SEQ ID NO: 69 - DNA, 990 bp, Arabidopsis thaliana
  CDS (1)..(990)
atgatcagtttcagagaagagaacatcgatctcaacttgattaaaacaattagtgtaatctgtaatgatccagacgccaccgattcctctagcgacgatgaatctatctccggcaataatcctcgccgtcagatcaaaccaaaaccaccgaaacgttacgtctcaaagatctgtgtcccgacgctgatcaaaaggtatgagaacgtttcgaattctacagggaataaagcagccggaaaccggaaaacgtcgtcgggtttcaaaggcgtacgacggaggccgtgggggaaatttgcggcggagataagaaatccgtttgagaagaagagaaagtggcttggaacgtttcctactgaagaagaagcagcagaagcttaccaaaagagtaaaagagagtttgatgaacgattgggtttagttaaacaggaaaaagacctagtagatttgaccaagccgtgcggtgtacgtaaaccagaagagaaggaagttactgagaagtcgaattgcaaaaaggtaaataagagaattgttactgatcagaagccatttggttgtggttataacgctgatcatgaagaagagggagtgattagtaaaatgttggaagatccgttgatgacatcgtcaattgctgatatttttggtgattcggctgttgaagcaaatgatatttgggtggattacaattcagtggaatttatttccattgtagatgatttcaagtttgattttgtggagaatgatagagtaggaaaggagaaaacatttggatttaagattggggatcacactaaagttaatcaacatgccaaaatcgtatcgaccaatggggacttattcgtcgatgatttacttgattttgatccgttgatagatgattttaagttagaagattttcctatggatgatcttggattattaggagatccagaggatgatgattttagttggtttaatggtactactgattggatcgataagtttttatga

SEQ ID NO: 70 - protein, 329 aa, Arabidopsis thaliana
MISFREENIDLNLIKTISVICNDPDATDSSSDDESISGNNPRRQIKPKPPKRYVSKICVPTLIKRYENVSNSTGNKAAGNRKTSSGFKGVRRRPWGKFAAEIRNPFEKKRKWLGTFPTEEEAAEAYQKSKREFDERLGLVKQEKDLVDLTKPCGVRKPEEKEVTEKSNCKKVNKRIVTDQKPFGCGYNADHEEEGVISKMLEDPLMTSSIADIFGDSAVEANDIWVDYNSVEFISIVDDFKFDFVENDRVGKEKTFGFKIGDHTKVNQHAKIVSTNGDLFVDDLLDFDPLIDDFKLEDFPMDDLGLLGDPEDDDFSWFNGTTDWIDKFL

SEQ ID NO: 71 - DNA, 636 bp, Arabidopsis thaliana
  CDS (1)..(636)
atggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctga

SEQ ID NO: 72 - protein, 211 aa, Arabidopsis thaliana
MVKTLQKTPKRMSSPSSSSSSSSSTSSSSIRMKKYKGVRMRSWGSWVSEIRAPNQKTRIWLGSYSTAEAAARAYDAALLCLKGSSANNLNFPEISTSLYHIINNGDNNNDMSPKSIQRVAAAAAAANTDPSSSSVSTSSPLLSSPSEDLYDVVSMSQYDQQVSLSESSSWYNCFDGDDQFMFINGVSAPYLTTSLSDDFFEEGDIRLWNFC

SEQ ID NO: 73 - DNA, 2364 bp, Arabidopsis thaliana
  CDS (1)..(2364)
atggaaaatcctccattagaatctgagatcaaagaggatatgtctttgaagaatcatcctccagacaaggataaggacaaagacactatcatggaacaacctagtagtccacgtcatcggaaggttgttgctagatggttacctgatgaagcacagaggccaattatcaatgacgctcccgtattcactccatcactagaggagtttgtagatccacttgcgtatatcgagaagatacgtccactagcagagccgtatggtatctgtcgaatcatcccaccatcgacatggaagcctccttgccggcttaaggagaagagtatatgggagcagacaaagtttcctactcggattcaaaccgtagacctgcttcagaaccgtgagccgatgaagaagaaaccgaagagtagaaagcggaaacggagaagaaactcgagaatgggttcgtctaagagacgatctggttcttctcccgctgaatcgacttcatcacccgaggctgaggagaagtttggtttcaattctggttcagacttcactcttgatgagtttgagaaatatgctctgcattttaaagactcgtactttgaaaagaaagactctggtggagatatagtaaaatggacaccgtctgtggatgatatagaaggggaatactggcggatagttgagcaaccaacagatgaagtggaggtttactatggagctgacttggagaatggggtgcttggaagcgggttttataaaagagccgagaagtttaccggtagcgatatggagcagtacacattatctggctggaacttgaataacttaccacggcttcctggctctgtactctcttttgaagattgtgacatatccggagttctagttccatggctatatgtgggaatgtgtttttcatcattttgttggcatgtggaggaccatcatttatattcacttaactatcatcactttggggagccaaaagtatggtatggtgttccaggaagcaatgcaaccgctctcgagaaggcgatgaggaaacatttacctgacttgttcgaagacagcctgatctactacatggcctgggcgtatcatgctggattcaactgcggtttcaactgcgcagaagcggttaatgtggctccggttgattggttggctcatggacagaacgctgtggaactatatagtaaagagacaaggaagacttctctgtctcacgacaagcttcttcttggagcagcttatgaagcggtgaaggctctttgggaactctcagcttctgagggaaaggaaaatacaacaaatttgagatggaagagtttctgtgggaagaacgggacacttaccaacgcgatacaagctcggttacaaatggaagaggggagaattacagctcttggtagggattcttcaagcttgaagaagatggagaaggactttgattcaaactgtgaaagggaatgtttctcatgcttttatgatttgcatctctcggcttctggctgcaagtgctctcccgaagaatacgcgtgccttaaacatgcagatgatctttgttcatgtgatgtgaaagatggatttattcttctccggtacacaatggatgagttaagctcgttggtcagagcattggaaggggaatcagatgatttaaagatatgggcttccaaggttttaggcattgaacatagtgatgaagatcagacaaagactagttcagttatcagtgaggagaagaagttaaaggaaggttcttttgatctgaacattgacttagagatggattatcaagaagacgttaaagaagaagccagcactagtggcggcgagttaaccgcctcagagaaccttggtgtatcggtcgagcctataaacctcgggttcttgatttttggaaagctttggtgcaataagtatgctatattcccaaaaggattcaggagtcgtgtcaagttctacaatgttcttgatccaacaagaatgagcaattacatctctgaggttttggatgcaggactcatgggtccattgttcagggttactctggaagaatctccagacgagagcttcttcaatgtctctgcacaacaatgctgggaaatggtgatgcggagagttaaagatacatcaacaagtcttggtcttcctattttaccacagtttgagagtatcaacgggcttcaaatgtttggtttcctctcaccctctatagttcaggccattgaagctcttgacccaaaccatcgactagttgagtactggaaccacaagaaccaaacttcatcagactcaaaagatcacttcatatcatcaaactgttccgcaagtttaaccaaaggaaaacttttcggagtagatttgatgtaa

SEQ ID NO: 74 - protein, 787 aa, Arabidopsis thaliana
MENPPLESEIKEDMSLKNHPPDKDKDKDTIMEQPSSPRHRKVVARWLPDEAQRPIINDAPVFTPSLEEFVDPLAYIEKIRPLAEPYGICRIIPPSTWKPPCRLKEKSIWEQTKFPTRIQTVDLLQNREPMKKKPKSRKRKRRRNSRMGSSKRRSGSSPAESTSSPEAEEKFGFNSGSDFTLDEFEKYALHFKDSYFEKKDSGGDIVKWTPSVDDIEGEYWRIVEQPTDEVEVYYGADLENGVLGSGFYKRAEKFTGSDMEQYTLSGWNLNNLPRLPGSVLSFEDCDISGVLVPWLYVGMCFSSFCWHVEDHHLYSLNYHHFGEPKVWYGVPGSNATALEKAMRKHLPDLFEDSLIYYMAWAYHAGFNCGFNCAEAVNVAPVDWLAHGQNAVELYSKETRKTSLSHDKLLLGAAYEAVKALWELSASEGKENTTNLRWKSFCGKNGTLTNAIQARLQMEEGRITALGRDSSSLKKMEKDFDSNCERECFSCFYDLHLSASGCKCSPEEYACLKHADDLCSCDVKDGFILLRYTMDELSSLVRALEGESDDLKIWASKVLGIEHSDEDQTKTSSVISEEKKLKEGSFDLNIDLEMDYQEDVKEEASTSGGELTASENLGVSVEPINLGFLIFGKLWCNKYAIFPKGFRSRVKFYNVLDPTRMSNYISEVLDAGLMGPLFRVTLEESPDESFFNVSAQQCWEMVMRRVKDTSTSLGLPILPQFESINGLQMFGFLSPSIVQAIEALDPNHRLVEYWNHKNQTSSDSKDHFISSNCSASLTKGKLFGVDLM

SEQ ID NO: 75 - DNA, 798 bp, Arabidopsis thaliana
  CDS (1)..(798)
atggccgacggtagtactagttcttcggagtccactaccgcctgcgctggaagcggcacaagaagagagattatgctgttcggagtcagggttgtgcttgacccgatgagaaagtgcgtgagtttgaacaatctgtctgactatgaacagacggcggagactccaaagatcgacggcgaagatagagatgaacaagatatgaacaaaaccccggccggttacgcctcggcggatgaagctcttcccatgtcttcttctaacggcaaaatcgagaggaaacgaggagttccatggactgaagaagaacacaagctgttcttgcttgggctgcagagagtcggtaaaggagattggaaaggaatatcaagaaactttgtcaagaccagaacctctacacaagttgctagtcatgctcagaaatacttcctcaggcgaagtaatcttaaccgtcgccgccgaagatctagcctttttgacatgactactgatacggtcatacccatggaagaagatcaccaagtgcttatacaggagaacacatctcaatcatcttctcctgtaccggaaatcaacaacttctctatacatccggttatgcaagtctttcccgagttcccggtaccaacagggaatcaatcatacggacagcttacttcatcgaatctcatcaatttggttccattaacttttcagtcaagtccagcaccgctttctctcaacctctcactagcttcatctaatcttaatgaaccatctccttcaatgcatccagcattcaacacgattggagtcgcttag

SEQ ID NO: 76 - protein, 265 aa, Arabidopsis thaliana
MADGSTSSSESTTACAGSGTRREIMLFGVRVVLDPMRKCVSLNNLSDYEQTAETPKIDGEDRDEQDMNKTPAGYASADEALPMSSSNGKIERKRGVPWTEEEHKLFLLGLQRVGKGDWKGISRNFVKTRTSTQVASHAQKYFLRRSNLNRRRRRSSLFDMTTDTVIPMEEDHQVLIQENTSQSSSPVPEINNFSIHPVMQVFPEFPVPTGNQSYGQLTSSNLINLVPLTFQSSPAPLSLNLSLASSNLNEPSPSMHPAFNTIGVA

SEQ ID NO: 77 - DNA, 2406 bp, Arabidopsis thaliana
  CDS (1)..(2406)
atgtcttctctgtcgcaatcgccaccaccgccggagatggatatccaacccccggcattggttaacgatgatccttccacttattcctccgctttatgggattggggagatctccttgacttcgccgcagacgaacgccttctcgtcgatcaaattcatttccctcccgttctctctcctcctctaccgcctctgattccgacgcaaactccggcggaatctgaattagatccttctccggaagaatcgggttctggttcggatcgggttaggaagcgagacccgaggttgatttgttccaatttcattgaaggtatgcttccttgttcgtgtcctgagcttgatcagaaattggaagacgccgagcttccgaagaagaaacgggttcgcggcgggtcgggcgtggctcgatgtcaggttccggattgtgaagcggatattagcgagctcaaagggtaccataagaggcatagggtttgtctccgttgcgctaccgccagctttgttgtgcttgatggagagaataagagatactgtcaacagtgtggaaagtttcatttgctcccggactttgatgaaggaaaacgcagctgtcggagaaagctagagcgtcacaacaacagacggaaaaggaaacctgtagataaaggaggtgttgctgcagaacaacagcaagtgctttcacagaatgataacagcgtcattgatgttgaggatggaaaagatatcacatgctctagtgaccagagagctgaagaagagccttcattgatttttgaagatcggcatattaccactcagggttctgtaccttttacccgaagcatcaacgcagacaactttgtctctgttacaggttcgggtgaagctcaaccagatgaaggaatgaatgacacaaaatttgaacgttcaccttctaatggcgacaacaaaagtgcttactcaactgtgtgtccaactggtcggatctcttttaagctctacgattggaatccagcggagttcccacggagactacgtcatcaaatatttcaatggttggccaacatgcctgttgagctggagggctatatccgcccaggatgtacaattttgactgtctttatagcaatgccagagattatgtgggcgaagttatctaaagatcctgtggcatatctggatgaatttattcttaaacctggaaagatgctgtttggaagaggctcgatgactgtctatttgaacaacatgattttccgtcttattaaaggtggaacaactttaaagagagtcgatgtaaaattagagtcgccgaaacttcagtttgtgtatcctacatgttttgaagctggaaaaccaattgaactcgttgtatgtggacaaaaccttctgcaacctaaatgccggtttctcgtgtctttttctgggaagtacttgccacataactattctgttgtacctgcaccggaccaggatgggaagcgttcttgtaataacaagttctacaagatcaatattgtgaattctgaccctagtctctttggccctgcctttgtcgaggttgaaaatgaatctggcctatcaaatttcatacctctaattattggagatgcagctgtttgttccgaaatgaaactaatagagcagaagttcaatgctacactctttccagagggacaagaagttactgcttgctcttctttgacttgctgttgcagggattttggggagagacagagcacctttagtggcctcttgttagatattgcatggtcggtgaaggtaccctctgcagaacgcactgagcaacctgtgaaccgatgtcagataaaaagatacaacagagtgttgaattatctgatacagaataactcagcgtcgatcttaggaaacgtactgcacaatttggaaactttggtgaagaaaatggagccagacagtcttgttcactgtacctgtgactgcgacgtgaggcttctacatgaaaatatggatttggcgagtgatattcacagaaagcatcaaagccctatagagtcaaaggtgaatcctccttcgtcaggttgctgttgtgtgagtagtcagaaggacataccatcaagaatattaaacttcaataaggatcctgaagcaggattagattgtaaagagagaatacaggcagactgttcaccagatagcggcggaaaagagactgatcctctgttaaacaaagaggttgtcatgaacgtaaatgacataggagactggccaaggaagtcgtgtataaaaacgcactcagctttagcattcaggtcccgtcaaactatgttcttaatcgctacgttcgctgtctgttttgctgtctgtgcggttctctaccatccaaacaaggtcacacagcttgcagtggcaatccgaatgagattggtacacaaaatttga

SEQ ID NO: 78 - protein, 801 aa, Arabidopsis thaliana
MSSLSQSPPPPEMDIQPPALVNDDPSTYSSALWDWGDLLDFAADERLLVDQIHFPPVLSPPLPPLIPTQTPAESELDPSPEESGSGSDRVRKRDPRLICSNFIEGMLPCSCPELDQKLEDAELPKKKRVRGGSGVARCQVPDCEADISELKGYHKRHRVCLRCATASFVVLDGENKRYCQQCGKFHLLPDFDEGKRSCRRKLERHNNRRKRKPVDKGGVAAEQQQVLSQNDNSVIDVEDGKDITCSSDQRAEEEPSLIFEDRHITTQGSVPFTRSINADNFVSVTGSGEAQPDEGMNDTKFERSPSNGDNKSAYSTVCPTGRISFKLYDWNPAEFPRRLRHQIFQWLANMPVELEGYIRPGCTILTVFIAMPEIMWAKLSKDPVAYLDEFILKPGKMLFGRGSMTVYLNNMIFRLIKGGTTLKRVDVKLESPKLQFVYPTCFEAGKPIELVVCGQNLLQPKCRFLVSFSGKYLPHNYSVVPAPDQDGKRSCNNKFYKINIVNSDPSLFGPAFVEVENESGLSNFIPLIIGDAAVCSEMKLIEQKFNATLFPEGQEVTACSSLTCCCRDFGERQSTFSGLLLDIAWSVKVPSAERTEQPVNRCQIKRYNRVLNYLIQNNSASILGNVLHNLETLVKKMEPDSLVHCTCDCDVRLLHENMDLASDIHRKHQSPIESKVNPPSSGCCCVSSQKDIPSRILNFNKDPEAGLDCKERIQADCSPDSGGKETDPLLNKEVVMNVNDIGDWPRKSCIKTHSALAFRSRQTMFLIATFAVCFAVCAVLYHPNKVTQLAVAIRMRLVHKI

SEQ ID NO: 79 - DNA, 789 bp, Arabidopsis thaliana
  CDS (1)..(789)
atgtgcggaggagctgtaatttccgattacatagcgccggagaagattgcgagatcatctggaaagtcttcctggagaagtaatggcgtctttgactgctcaatctacgatttcgatggaaatttcgatgaattagagtccgatgagccatttgtcttctcctctactcacaaacatcatgcttcaggctcagcatcagatgggaagaagaaacagagcagtcggtacaaaggaatcagaagaaggccttggggaagatgggcggctgagatacgtgatccaatcaaaggagttcgagtttggctcgggactttcaacacagctgaagaagctgcaagagcttatgatcttgaagctaagagaatccgtggagccaaagctaagctcaatttccctaacgaatcctctggaaagaggaaagccaaggctaagactgtgcaacaggtagaggagaatcatgaggctgatcttgatgtggcggtggtaagctcagcgcctagtagtagctgtcttgatttcttgtgggaggagaataatccggacacgcttctgattgatacacaatggctcgaagatatcatcatgggcgatgcgaataagaaacatgaacctaatgatagtgaagaagccaacaacgttgatgcttctctgctttctgaagagcttcttgcttttgagaaccagaccgaatatttctcgcagatgccttttacggagggaaactgtgattcctcaacgtctctgagtagtctctttgatggaggcaatgacatgggtctatggtcctga

SEQ ID NO: 80 - protein, 262 aa, Arabidopsis thaliana
MCGGAVISDYIAPEKIARSSGKSSWRSNGVFDCSIYDFDGNFDELESDEPFVFSSTHKHHASGSASDGKKKQSSRYKGIRRRPWGRWAAEIRDPIKGVRVWLGTFNTAEEAARAYDLEAKRIRGAKAKLNFPNESSGKRKAKAKTVQQVEENHEADLDVAVVSSAPSSSCLDFLWEENNPDTLLIDTQWLEDIIMGDANKKHEPNDSEEANNVDASLLSEELLAFENQTEYFSQMPFTEGNCDSSTSLSSLFDGGNDMGLWS

SEQ ID NO: 81 - DNA, 1077 bp, Arabidopsis thaliana
  CDS (1)..(1077)
atggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatga

SEQ ID NO: 82 - protein, 358 aa, Arabidopsis thaliana
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 83 - DNA, 621 bp, Arabidopsis thaliana
  CDS (1)..(621)
atggaggtggagaagaggattgtagtgaatggaggaatgaaattgccaataggatacagatttcacccaaccgagcaagagcttatccttcattacttgctcccaaaggcctttgcttctcctttgccttcctccatcatccctgtctttgacctcttcttctctcatcctcttagtttcccaggggaccaaaaggagaagcagaggtacttcttttgcaagaagagagaagtgtcaagtaatgagcatagaatcaagatttcctctggtgatggttattggaaacctattggtaaagagagaccaatcattgcctgtggtaaaacatttgggattagaagaacacttgctttctatgaaacaaacaagtcttcttcttattgcaacaaaactagatggagcatgacagagtattgtcttgcgggatttgcgtcggctaaggtgtctggagaatgggcagtgtacaatgtttatgagaggaaaggctcaaaaggaagaaaacagaggaaatcaagagagggagatgatgaagaattgagatgcatcgaccattttacggttgggtcaaatcatgaaaccggtccaccaccgccttctcctcctacctcagctgatgagtaa

SEQ ID NO: 84 - protein, 206 aa, Arabidopsis thaliana
MEVEKRIVVNGGMKLPIGYRFHPTEQELILHYLLPKAFASPLPSSIIPVFDLFFSHPLSFPGDQKEKQRYFFCKKREVSSNEHRIKISSGDGYWKPIGKERPIIACGKTFGIRRTLAFYETNKSSSYCNKTRWSMTEYCLAGFASAKVSGEWAVYNVYERKGSKGRKQRKSREGDDEELRCIDHFTVGSNHETGPPPPSPPTSADE

SEQ ID NO: 85 - DNA, 930 bp, Arabidopsis thaliana
  CDS (1)..(930)
atgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtag

SEQ ID NO: 86 - protein, 309 aa, Arabidopsis thaliana
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 87 - DNA, 1245 bp, Arabidopsis thaliana
  CDS (1)..(1245)
atggcaattgtatcctccacaacaagcatcattcccatgagtaaccaagtcaacaataacgaaaaaggtatagaagacaatgatcatagaggcggccaagagagtcatgtccaaaatgaagatgaagctgatgatcatgatcatgacatggtcatgcccggatttagattccatcctaccgaagaagaactcatagagttttaccttcgccgaaaagttgaaggcaaacgctttaatgtagaactcatcactttcctcgatctttatcgctatgatccttgggaacttcctgctatggcggcgataggagagaaagagtggtacttctatgtgccaagagatcggaaatatagaaatggagatagaccgaaccgagtaacgacttcaggatattggaaagccaccggagctgataggatgatcagatcggagacttctcggcctatcggattaaagaaaaccctagttttctactctggtaaagcccctaaaggcactcgtactagttggatcatgaacgagtatcgtcttccgcaccatgaaaccgagaagtaccaaaaggctgaaatatcattgtgccgagtgtacaaaaggccaggagtagaagatcatccatcggtaccacgttctctctccacaagacatcataaccataactcatcgacatcatcccgtttagccttaagacaacaacaacaccattcatcctcctctaatcattccgacaacaaccttaacaacaacaacaacatcaacaatctcgagaagctctccaccgaatattccggcgacggcagcacaacaacaacgaccacaaacagtaactctgacgttaccattgctctagccaatcaaaacatatatcgtccaatgccttacgacacaagcaacaacacattgatagtctctacgagaaatcatcaagacgatgatgaaactgccattgttgacgatcttcaaagactagttaactaccaaatatcagatggaggtaacatcaatcaccaatactttcaaattgctcaacagtttcatcatactcaacaacaaaatgctaacgcaaacgcattacaattggtggctgcggcgactacagcgacaacgctaatgcctcaaactcaagcggcgttagctatgaacatgattcctgcaggaacgattccaaacaatgctttgtgggatatgtggaatccaatagtaccagatggaaacagagatcactatactaatattccttttaagtaa

SEQ ID NO: 88 - protein, 414 aa, Arabidopsis thaliana
MAIVSSTTSIIPMSNQVNNNEKGIEDNDHRGGQESHVQNEDEADDHDHDMVMPGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEYRLPHHETEKYQKAEISLCRVYKRPGVEDHPSVPRSLSTRHHNHNSSTSSRLALRQQQHHSSSSNHSDNNLNNNNNINNLEKLSTEYSGDGSTTTTTTNSNSDVTIALANQNIYRPMPYDTSNNTLIVSTRNHQDDDETAIVDDLQRLVNYQISDGGNINHQYFQIAQQFHHTQQQNANANALQLVAAATTATTLMPQTQAALAMNMIPAGTIPNNALWDMWNPIVPDGNRDHYTNIPFK

SEQ ID NO: 89 - DNA, 1182 bp, Arabidopsis thaliana
  CDS (1)..(1182)
atggactgcaacatggtatcttcgtcccagtgggattgggagcatttgatcatgtccaatccgtcaaggactgaagatgacagcaaacagctacctactgagtgggaaattgaaaaaggtgaaggaattgaatctatagttccacatttctcaggccttgagagagtcagtagtggctctgccaccagcttctggcacactgctgtatcgaaaagctcacagtcgacctctatcaactcatcatctcccgaagccaaacgatgcaagcttgcatcagaaagttcccctggagattcttgcagcaacatagactttgtccaggtgaaggctcccacagctctcgaggtatccgttgcctcagctgaatcagatctttgtttaaaactaggaaagcggacatactctgaagaatactggggtagaaacaataatgaaatttcagcggtttctatgaagttgttaactccatctgttgtcgctgggaaatccaaattgtgtggtcagagcatgccagtcccgcgttgccaaattgatggctgtgaactggatctctcatctgctaagggttatcatcgtaagcacaaagtctgcgaaaagcattcaaagtgcccaaaagttagcgtgagtggcctggaacgtcggttctgccaacagtgtagcaggttccatgctgtctctgaatttgatgagaagaaacgaagctgccgaaaacgtctttctcatcataatgcgaggcgtcgtaagccacaaggagtattttcaatgaatcccgagagggtgtatgatcgaagacagcatacaaatatgttgtggaatggggtgtcccttaacgcgagatctgaagaaatgtatgaatggggtaataacacttatgatacaaagcctagacaaacggaaaaaagctttactctgagcttccagagaggtaatggctctgaggaccagctggttgctagtagcagccgtatgttctctacatctcaaacctcaggtgggttcccagcaggaaagtccaagtttcaacttcatggcgaagatgtgggagaatactcaggagtcctccatgaatctcaagatatccaccgtgctctctctcttctgtcaacctcttcggatcccctggcccaaccacatgtgcagccattttctctactctgttcatatgatgttgtaccaaaatag

SEQ ID NO: 90 - protein, 393 aa, Arabidopsis thaliana
MDCNMVSSSQWDWEHLIMSNPSRTEDDSKQLPTEWEIEKGEGIESIVPHFSGLERVSSGSATSFWHTAVSKSSQSTSINSSSPEAKRCKLASESSPGDSCSNIDFVQVKAPTALEVSVASAESDLCLKLGKRTYSEEYWGRNNNEISAVSMKLLTPSVVAGKSKLCGQSMPVPRCQIDGCELDLSSAKGYHRKHKVCEKHSKCPKVSVSGLERRFCQQCSRFHAVSEFDEKKRSCRKRLSHHNARRRKPQGVFSMNPERVYDRRQHTNMLWNGVSLNARSEEMYEWGNNTYDTKPRQTEKSFTLSFQRGNGSEDQLVASSSRMFSTSQTSGGFPAGKSKFQLHGEDVGEYSGVLHESQDIHRALSLLSTSSDPLAQPHVQPFSLLCSYDVVPK

SEQ ID NO: 91 - DNA, 555 bp, Arabidopsis thaliana
  CDS (1)..(555)
atggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattga

SEQ ID NO: 92 - protein, 184 aa, Arabidopsis thaliana
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 93 - DNA, 687 bp, Arabidopsis thaliana
  CDS (1)..(687)
atgagaataaggagaagagatgaaaaagagaatcaagaatacaagaaaggtttatggacagttgaagaagacaacatccttatggactatgttcttaatcatggcactggccaatggaaccgcatcgtcagaaaaactgggctaaagagatgtgggaaaagttgtagactgagatggatgaattatttgagccctaatgtgaacaaaggcaatttcactgaacaagaagaagacctcattattcgtctccacaagctcctcggcaatagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttag

SEQ ID NO: 94 - protein, 228 aa, Arabidopsis thaliana
MRIRRRDEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSPPSLFITAATPSSCHHQQENIYENIAKSFNGVVSASYEDKPKQELAQKDVLMATTNDPSHYYGNNALWVHDDDFELSSLVMMNFASGDVEYCL

SEQ ID NO: 95 - DNA, 1302 bp, Arabidopsis thaliana
  CDS (1)..(1302)
atgaacaacaacattttcagtactactaccaccatcaatgacgactacatgttattcccttataatgaccattattcctcacaaccattgctcccttttagcccttcttcttccattaacgacatcttgattcactccacctctaacacatcaaacaatcatcttgaccatcatcatcaattccaacaaccttctcctttttctcacttcgaatttgccccggactgcgccctcctcacctctttccacccagaaaacaatggccatgatgataaccaaaccatcccaaacgacaatcatcatccatcacttcactttcccttgaacaacaccattgtagaacaacccactgagccctcggaaactataaaccttatagaagattcccagagaatctcaacttctcaagacccaaaaatgaaaaaagccaagaaacccagcagaacggacaggcacagcaagatcaaaacggccaaagggacacgagatcgtaggatgagactctcgctagatgtcgccaaagagttgtttggcttacaagacatgcttggatttgacaaagccagcaaaaccgttgaatggttgcttacacaagcaaaacctgagatcataaagatcgcgacaaccctttctcaccatggctgcttcagcagcggcgatgagtctcatatccgaccggtgttaggatccatggacacatcttctgatctatgtgaacttgcatccatgtggacggtcgacgatagaggcagcaatactaacacgaccgaaacaagaggaaacaaggtcgatgggagatcgatgagagggaagagaaagaggccagaaccgcgaacgcccattttaaagaagttgtccaaggaggagagagcgaaagctagagaaagagcaaagggtagaacaatggagaaaatgatgatgaagatgaaaggaagatcacaattagtgaaagttgtggaagaagacgctcatgatcatggtgagataataaagaataataatagaagccaagtgaatcggagttcttttgagatgacacactgcgaagacaagatcgaagaactttgcaagaacgatcgttttgcagtttgcaacgaatttatcatgaataagaaagatcacatttcaaatgaatcttatgacttagtcaactacaaaccgaactcatcattcccagtgattaaccaccatcgcagccaaggagcagctaattccattgagcagcatcagtttacggatcttcattactccttcggcgcgaaaccaagagacctcatgcacaactatcaaaacatgtattga

SEQ ID NO: 96 - protein, 433 aa, Arabidopsis thaliana
MNNNIFSTTTTINDDYMLFPYNDHYSSQPLLPFSPSSSINDILIHSTSNTSNNHLDHHHQFQQPSPFSHFEFAPDCALLTSFHPENNGHDDNQTIPNDNHHPSLHFPLNNTIVEQPTEPSETINLIEDSQRISTSQDPKMKKAKKPSRTDRHSKIKTAKGTRDRRMRLSLDVAKELFGLQDMLGFDKASKTVEWLLTQAKPEIIKIATTLSHHGCFSSGDESHIRPVLGSMDTSSDLCELASMWTVDDRGSNTNTTETRGNKVDGRSMRGKRKRPEPRTPILKKLSKEERAKARERAKGRTMEKMMMKMKGRSQLVKVVEEDAHDHGEIIKNNNRSQVNRSSFEMTHCEDKIEELCKNDRFAVCNEFIMNKKDHISNESYDLVNYKPNSSFPVINHHRSQGAANSIEQHQFTDLHYSFGAKPRDLMHNYQNMY

SEQ ID NO: 97 - DNA, 963 bp, Arabidopsis thaliana
  CDS (1)..(963)
atggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcatatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttga

SEQ ID NO: 98 - protein, 320 aa, Arabidopsis thaliana
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 99 - DNA, 792 bp, Arabidopsis thaliana
  CDS (1)..(792)
atggcgaattcaggaaattatggaaagaggccctttcgaggcgatgaatcggatgaaaagaaagaagccgatgatgatgagaacatattccctttcttctctgcccgatcccaatatgacatgcgtgccatggtctcagccttgactcaagtcattggaaaccaaagcagctctcatgataataaccaacatcaacctgttgtgtataatcaacaagatcctaacccaccggctcctccaactcaagatcaagggctattgaggaagaggcactatagaggggtaagacaacgaccatggggaaagtgggcagctgaaattcgggatccgcaaaaggcagcacgggtgtggctcgggacatttgagactgctgaagctgcggctttagcttatgataacgcagctcttaagttcaaaggaagcaaagccaaactcaatttccctgagagagctcaactagcaagtaacactagtacaactaccggtccaccaaactattattcttctaataatcaaatttactactcaaatccgcagactaatccgcaaaccataccttattttaaccaatactactataaccaatatcttcatcaaggggggaatagtaacgatgcattaagttatagcttggccggtggagaaaccggaggctcaatgtataatcatcagacgttatctactacaaattcttcatcttctggtggatcttcaaggcaacaagatgatgaacaagattacgccagatatttgcgttttggggattcttcacctcctaattctggtttttga

SEQ ID NO: 100 - protein, 263 aa, Arabidopsis thaliana
MANSGNYGKRPFRGDESDEKKEADDDENIFPFFSARSQYDMRAMVSALTQVIGNQSSSHDNNQHQPVVYNQQDPNPPAPPTQDQGLLRKRHYRGVRQRPWGKWAAEIRDPQKAARVWLGTFETAEAAALAYDNAALKFKGSKAKLNFPERAQLASNTSTTTGPPNYYSSNNQIYYSNPQTNPQTIPYFNQYYYNQYLHQGGNSNDALSYSLAGGETGGSMYNHQTLSTTNSSSSGGSSRQQDDEQDYARYLRFGDSSPPNSGF

SEQ ID NO: 101 - DNA, 1059 bp, Arabidopsis thaliana
  CDS (1)..(1059)
atgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtga

SEQ ID NO: 102 - protein, 352 aa, Arabidopsis thaliana
MGSNFHYTIDLNEDQNHQPFFASLGSSLHHHLQQQQQQQQHFHHQASSNPSSLMSPSLSYFPFLINSRQDQVYVGYNNNTFHDVLDTHISQPLETKNFVSDGGSSSSDQMVPKKETRLKLTIKKKDNHQDQTDLPQSPIKDMTGTNSLKWISSKVRLMKKKKAIITTSDSSKQHTNNDQSSNLSNSERQNGYNNDCVIRICSDCNTTKTPLWRSGPRGPKSLCNACGIRQRKARRAAMATATATAVSGVSPPVMKKKMQNKNKISNGVYKILSPLPLKVNTCKRMITLEETALAEDLETQSNSTMLSSSDNIYFDDLALLLSKSSAYQQVFPQDEKEAAILLMALSHGMVHG

SEQ ID NO: 103 - DNA, 1416 bp, Arabidopsis thaliana
  CDS (1)..(1416)
atggagttggagcctatatcatcgagttgttgctcgtcgtcttcttcttcttctggggaggagaatactgcggcggcgaacatgacggagatggaggcggcagaagcattggcggatttagcgcagcttgcgataatgcgagagcaggttttcgaatctgcagcgagttggggaagtaaagggaaacgggtgaggaagcgagtcaagactgagtctcctccttctgactcgcttttgaaaccacctgactctgatacgttacctactccggatctagctgaggaacgattagtgaaagaagaagaggaagaagaagaagttgaaccaataactaaagaactaactaaagctccggttaaatctgaaatcaatggtgaaacacctaaaccaattcttgcttcgactctaataaggtgtagtagatcaaatggttgtggccgatcaagacagaatttaagtgaggctgaaagagaagaacgtagaatcagaaggatattagctaatagagaatctgcgaggcagacaattcggcgaagacaggcaatgtgtgaggagttgagtaaaaaagcagctgatctgacatatgagaatgagaatttgaggagggaaaaggattgggctttgaaagagtttcagtctttggagacgattaacaagcatttaaaggaacaggtattgaagtcagtaaaacccgatacaaaagagcctgaagaatcacccaagccatcacaagttgagatgtctacatcatctactccgttttacttctacaaccagaatccatatcagcttttctgctggcctcatgttactcaatcatcaaatccaatgatatcgccacttgaattccctacttcgggaggagcttctgctaaaactattaccacgcaggagcatgaaaatgctgcagatgataatgggcaaaaaactcacttttacgttgtaccttgcccttggtttctccctcctcctgatcacagcaatggtgttcctttcgggcttcaagatacacaaagaggtactttttcaaacgggcaccatatcgatgattcttctgcaagaccgatggatgtcacagaaactccgcggtcccatctaccaactagaatcaaagaagaggactctggttcacccgaaaccagacctttatatgatctcaacgaatctgctactgaagtcctctcagaaggaggagatggatttcctgtaacgcagcaagcttatagtttaaagcatgaagatgtttctgagacaactaatggagttacactgatgccgcctggtcatcatgttttgatttctctaccggagaaaaagcatggatcgttggctgcagcggaagctagaaagagacggaaagaactcacaaggctcaagaacctccatggccgtcaatgtcggatgcaggtcggataa

SEQ ID NO: 104 - protein, 471 aa, Arabidopsis thaliana
MELEPISSSCCSSSSSSSGEENTAAANMTEMEAAEALADLAQLAIMREQVFESAASWGSKGKRVRKRVKTESPPSDSLLKPPDSDTLPTPDLAEERLVKEEEEEEEVEPITKELTKAPVKSEINGETPKPILASTLIRCSRSNGCGRSRQNLSEAEREERRIRRILANRESARQTIRRRQAMCEELSKKAADLTYENENLRREKDWALKEFQSLETINKHLKEQVLKSVKPDTKEPEESPKPSQVEMSTSSTPFYFYNQNPYQLFCWPHVTQSSNPMISPLEFPTSGGASAKTITTQEHENAADDNGQKTHFYVVPCPWFLPPPDHSNGVPFGLQDTQRGTFSNGHHIDDSSARPMDVTETPRSHLPTRIKEEDSGSPETRPLYDLNESATEVLSEGGDGFPVTQQAYSLKHEDVSETTNGVTLMPPGHHVLISLPEKKHGSLAAAEARKRRKELTRLKNLHGRQCRMQVG

SEQ ID NO: 105 - DNA, 2514 bp, Arabidopsis thaliana
  CDS (1)..(2514)
atggcaatgtcttgcaaggatggtaagttgggatgtttggataatgggaagtatgtgaggtatacacctgaacaagttgaagcacttgagaggctttatcatgactgtcctaaaccgagttctattcgccgtcagcagttgatcagagagtgtcctattctctctaacattgagcctaaacagatcaaagtgtggtttcagaaccgaagatgtagagagaaacaaaggaaagaggcttcacggcttcaagctgtgaatcggaagttgacggcaatgaacaagctcttgatggaggagaatgacaggttgcagaagcaagtgtcacagctggtccatgaaaacagctacttccgtcaacatactccaaatccttcactcccagctaaagacacaagctgtgaatcggtggtgacgagtggtcagcaccaattggcatctcaaaatcctcagagagatgctagtcctgcaggacttttgtccattgcagaagaaactttagcagagtttctttcaaaggcaactggaaccgctgttgagtgggttcagatgcctggaatgaagcctggtccggattccattggaatcatcgctatttctcatggttgcactggtgtggcagcacgcgcctgtggcctagtgggtcttgagcctacaagggttgcagagattgtcaaggatcgtccttcgtggttccgcgaatgtcgagctgttgaagttatgaacgtgttgccaactgccaatggtggaaccgttgagctgctttatatgcagctctatgcaccaactacattggccccaccacgcgatttctggctgttacgttacacctctgttttagaagatggcagccttgtggtgtgcgagagatctcttaagagcactcaaaatggtcctagtatgccactggttcagaattttgtgagagcagagatgctttccagtgggtacttgatacggccttgtgatggtggtggctcaatcatacacatagtggatcatatggatttggaggcttgtagcgtgcctgaggtcttgcgcccgctctatgagtcacccaaagtacttgcacagaagacaacaatggcggcactgcgtcagctcaagcaaatagctcaggaggttactcagactaatagtagtgttaatgggtggggacggcgtcctgctgccttaagagctctcagccagaggctaagcagaggcttcaatgaagctgtaaatggtttcactgatgaaggatggtcagtgataggagatagcatggatgatgtcacaatcactgtaaactcttctccagacaagctaatgggtctaaatcttacatttgccaatggctttgctcctgtaagcaatgttgttttatgcgcaaaagcatcaatgcttttacagaatgttcctccggcgatcctgcttcggtttctgagggagcataggtcagaatgggctgacaacaacattgatgcgtatctagcagcagcagttaaagtagggccttgtagtgcccgagttggaggatttggagggcaggttatacttccacttgctcatactattgagcatgaagagtttatggaagtcatcaaattggaaggtcttggtcattcccctgaagatgcaatcgttccaagagatatcttccttcttcaactttgtagcggaatggatgaaaatgctgtaggaacctgtgcggaacttatatttgctccaatcgatgcttcgtttgcggatgatgcacctctgcttccttctggttttcgtattatccctcttgattccgcaaagcaggaagtatctagcccaaaccgaaccttggatcttgcttcggcactggaaattggttcagctggaacaaaagcctcaactgatcaatcaggaaactccacatgtgcaagatctgtgatgacaatagcatttgagtttggtatcgagagccatatgcaagaacatgtagcatccatggctaggcagtatgttcgaggtatcatatcatcggtgcagagagtagcattggctctttctccttctcatatcagctcacaagttggtctacgcactcctttgggtactcctgaagcccaaacacttgctcgttggatttgccagagttacaggggctacatgggtgttgagctacttaaatcaaacagtgacggcaatgaatctattcttaagaatctttggcatcacactgatgctataatctgctgctcaatgaaggccttgcccgtcttcacatttgcaaaccaggcgggacttgacatgctggagactacattagttgctcttcaagacatctctttagagaagatatttgatgacaatggaagaaagactctttgctctgagttcccacagatcatgcaacagggcttcgcgtgccttcaaggcgggatatgtctctcaagcatggggagaccagtttcgtatgagagagcagttgcttggaaagtactcaatgaagaagaaaatgctcattgcatctgctttgtgttcatcaattggtcctttgtgtga

SEQ ID NO: 106 - protein, 837 aa, Arabidopsis thaliana
MAMSCKDGKLGCLDNGKYVRYTPEQVEALERLYHDCPKPSSIRRQQLIRECPILSNIEPKQIKVWFQNRRCREKQRKEASRLQAVNRKLTAMNKLLMEENDRLQKQVSQLVHENSYFRQHTPNPSLPAKDTSCESVVTSGQHQLASQNPQRDASPAGLLSIAEETLAEFLSKATGTAVEWVQMPGMKPGPDSIGIIAISHGCTGVAARACGLVGLEPTRVAEIVKDRPSWFRECRAVEVMNVLPTANGGTVELLYMQLYAPTTLAPPRDFWLLRYTSVLEDGSLVVCERSLKSTQNGPSMPLVQNFVRAEMLSSGYLIRPCDGGGSIIHIVDHMDLEACSVPEVLRPLYESPKVLAQKTTMAALRQLKQIAQEVTQTNSSVNGWGRRPAALRALSQRLSRGFNEAVNGFTDEGWSVIGDSMDDVTITVNSSPDKLMGLNLTFANGFAPVSNVVLCAKASMLLQNVPPAILLRFLREHRSEWADNNIDAYLAAAVKVGPCSARVGGFGGQVILPLAHTIEHEEFMEVIKLEGLGHSPEDAIVPRDIFLLQLCSGMDENAVGTCAELIFAPIDASFADDAPLLPSGFRIIPLDSAKQEVSSPNRTLDLASALEIGSAGTKASTDQSGNSTCARSVMTIAFEFGIESHMQEHVASMARQYVRGIISSVQRVALALSPSHISSQVGLRTPLGTPEAQTLARWICQSYRGYMGVELLKSNSDGNESILKNLWHHTDAIICCSMKALPVFTFANQAGLDMLETTLVALQDISLEKIFDDNGRKTLCSEFPQIMQQGFACLQGGICLSSMGRPVSYERAVAWKVLNEEENAHCICFVFINWSFV

SEQ ID NO: 107 - DNA, 1017 bp, Arabidopsis thaliana
  CDS (1)..(1017)
atggtggaagaaggcggcgtagttgtgaatcaaggaggagatcaggaggtggtggatttgcctccggggtttcggtttcaccctactgatgaagagataataactcactacctcaaagagaaggtcttcaacatccgatttaccgcggcagcgattggtcaagccgacctcaacaagaacgagccatgggatctaccaaagattgcaaagatgggggagaaggagttttactttttctgccagagggatcggaagtatccgaccgggatgaggacgaaccgtgcgaccgtgtctggttattggaaggcgaccgggaaggacaaggagatctttagaggcaaaggttgtcttgttgggatgaagaaaacacttgttttctatacaggaagagctcctaaaggtgaaaagaccaattgggttatgcatgaatatcgtcttgatggaaaatattcttatcataacctccccaaaaccgcaagggatgaatgggtggtgtgtagggtttttcacaagaacgctcctagtactacaatcactactacaaaacaactctcaaggattgattctcttgataacattgatcatctcttagacttctcatctctccctcctctcatagatccgggtttcttgggtcaacccggcccaagcttctccggtgcccgtcaacaacacgatctcaaacctgttctccaccatcctacaaccgcaccagtcgacaacacttaccttcctacccaagctctcaatttcccttaccactcggtccataattccggatctgatttcggctacggggcaggttcaggcaataataacaaaggtatgatcaagttggagcattctcttgtgagtgtgtctcaagaaaccggtttgagttccgatgtgaacacaaccgcaacgccagagatatcttcttatccaatgatgatgaatccggcaatgatggatggtagcaagtcagcgtgtgatggtcttgatgacttgatcttctgggaagatttatatactagctaa

SEQ ID NO: 108 - protein, 338 aa, Arabidopsis thaliana
MVEEGGVVVNQGGDQEVVDLPPGFRFHPTDEEIITHYLKEKVFNIRFTAAAIGQADLNKNEPWDLPKIAKMGEKEFYFFCQRDRKYPTGMRTNRATVSGYWKATGKDKEIFRGKGCLVGMKKTLVFYTGRAPKGEKTNWVMHEYRLDGKYSYHNLPKTARDEWVVCRVFHKNAPSTTITTTKQLSRIDSLDNIDHLLDFSSLPPLIDPGFLGQPGPSFSGARQQHDLKPVLHHPTTAPVDNTYLPTQALNFPYHSVHNSGSDFGYGAGSGNNNKGMIKLEHSLVSVSQETGLSSDVNTTATPEISSYPMMMNPAMMDGSKSACDGLDDLIFWEDLYTS

SEQ ID NO: 109 - DNA, 666 bp, Arabidopsis thaliana
  CDS (1)..(666)
atggcggattcgtcttccgacaaggagaagaaggaaaataataagcagcccgtgtatcgtggagtccgtatgaggagctggggaaaatgggtatcggagattcgcgaaccgaggaagaaatcgagaatctggctcgggacttttccgacggcggagatggctatgcgtgctcacgacgtggcggctatgagtatcaaaggaacttcagccattctcaatttccctgagctctctaaacttcttccccgacccgtttcgctcagccctcgtgacgtcagagctgcggcgaccaaagctgctctcatggacttcgatacgacggcgtttcgttcggatactgagactagcgaaacgacgacgtcgaataaaatgtcagagagtagtgagagtaacgaaacggtgtcgttctcatcgtcgtcttggtcctctgttacgagcattgaggaaagtacagtctccgacgatcttgacgagatcgtaaagttaccgagtctaggaacgagcctaaacgagtcgaacgagttcgtgatatttgactcgttggaggatttggtgtacatgcctcggtggttaagcggtacggaagaagaagtttttacgtataataacaatgattcttcgttgaattactcatcagttttcgaatcttggaaacattttccctga

SEQ ID NO: 110 - protein, 221 aa, Arabidopsis thaliana
MADSSSDKEKKENNKQPVYRGVRMRSWGKWVSEIREPRKKSRIWLGTFPTAEMAMRAHDVAAMSIKGTSAILNFPELSKLLPRPVSLSPRDVRAAATKAALMDFDTTAFRSDTETSETTTSNKMSESSESNETVSFSSSSWSSVTSIEESTVSDDLDEIVKLPSLGTSLNESNEFVIFDSLEDLVYMPRWLSGTEEEVFTYNNNDSSLNYSSVFESWKHFP

SEQ ID NO: 111 - DNA, 879 bp, Arabidopsis thaliana
  CDS (1)..(879)
atgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaa

SEQ ID NO: 112 - protein, 292 aa, Arabidopsis thaliana
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 113 - DNA, 759 bp, Arabidopsis thaliana
  CDS (1)..(759)
atggataatgtcaaacttgttaagaatggtgttttgagattgccacctggattcagattccatcctactgatgaagaacttgtggttcaataccttaagaggaaagtttgttcttctcctttgccagcttcaatcatccctgagtttgatgtttgcagagctgatccttgggatttacctggcaatttggagaaagagaggtacttctttagcacaagggaagctaaatacccaaatgggaaccggtctaaccgggcaactgggtctggttattggaaagctaccggtattgataaacgggttgtgacctctagaggaaatcaaatcgttggtttgaagaaaactcttgtcttctacaaaggcaaaccacctcatggctcaagaaccgattggatcatgcacgaatatcgcctctcttcttctcctccgagttctatgggtcccactcagaactgggtactctgtcgtatcttcttgaagaaaagagccggtaacaagaacgacgacgacgacggagatagccgtaatcttagacataataataataacaattcgagtgaccaaattgagataattacaacagaccaaacagatgataaaacaaaaccaatcttctttgatttcatgagaaaagaaagaacaacagatttgaaccttttgccgagctctccttcttccgatcatgcttcaagtggagtcacgacggagatcttctcttcttccgatgaagagaccagtagttgcaatagtttcagatga

SEQ ID NO: 114 - protein, 252 aa, Arabidopsis thaliana
MDNVKLVKNGVLRLPPGFRFHPTDEELVVQYLKRKVCSSPLPASIIPEFDVCRADPWDLPGNLEKERYFFSTREAKYPNGNRSNRATGSGYWKATGIDKRVVTSRGNQIVGLKKTLVFYKGKPPHGSRTDWIMHEYRLSSSPPSSMGPTQNWVLCRIFLKKRAGNKNDDDDGDSRNLRHNNNNNSSDQIEIITTDQTDDKTKPIFFDFMRKERTTDLNLLPSSPSSDHASSGVTTEIFSSSDEETSSCNSFR

SEQ ID NO: 115 - DNA, 636 bp, Arabidopsis thaliana
  CDS (1)..(636)
atggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgaaaagatagaggaaaacaacaatagcatattagatgctaacttcgcagtcatggagacaaactattcctatccgctaacaatgccaagtgaaatatttcagttctag

SEQ ID NO: 116 - protein, 211 aa, Arabidopsis thaliana
MARGKIQLKRIENPVHRQVTFCKRRTGLLKKAKELSVLCDAEIGVVIFSPQGKLFELATKGTMEGMIDKYMKCTGGGRGSSSATFTAQEQLQPPNLDPKDEINVLKQEIEMLQKGISYMFGGGDGAMNLEELLLLEKHLEYWISQIRSAKMDVMLQEIQSLRNKEGVLKNTNKYLLEKIEENNNSILDANFAVMETNYSYPLTMPSEIFQF

SEQ ID NO: 117 - DNA, 684 bp, Arabidopsis thaliana
  CDS (1)..(684)
atggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaa

SEQ ID NO: 118 - protein, 227 aa, Arabidopsis thaliana
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 119 - DNA, 888 bp, Arabidopsis thaliana
  CDS (1)..(888)
atgggagctccaaagctgaagtggacaccagaagaagaaacagctcttaaagctggagtacttaaacatggaactggaaaatggcgtaccattctctcagatcctgtgtatagcacaattctgaagtctcgttctaatgtggatctcaaggacaaatggagaaatataagtgtaacagctttatggggatctaggaagaaggctaagcttgctcttaaaagaactcctttgtcgggtagtaggcaagacgataacgctacagctattaccattgtgtctttagctaatggtgatgtaggaggacaacagattgatgcaccatctcctcctgcaggttcttgtgaacctccaagaccttctacaagtgtggataagattatattggaggctattaccagcttgaagagaccatttggtcctgacggaaagtcgatcttgatgtatatagaggagaatttcaagatgcaaccggatatgaaacggcttgtgacttcaaggctgaagtatttgacaaatgttggaacattagttaagaaaaagcacaaatacaggatttctcagaattatatggctgaaggagaaggacaaaggtctcctcaactcttgttggaaggaaacaaggaaaacactccgaaaccggaggagaatggcgtcaaaaatcttactaaatcccaagtaggtggagaagttatgataatgggtatgacagaaaaagaagctgctgcagcagctgcaagagctgtggcagaagcagaatttgcaatggcagaagctgaagaagcagcaagagaggcagataaagcagaagccgaagctgaagctgcccatatttttgcaaaagcggcgatgaaagctgtgaagtatagaatgcatagccaaactcggtaa

SEQ ID NO: 120 - protein, 295 aa, Arabidopsis thaliana
MGAPKLKWTPEEETALKAGVLKHGTGKWRTILSDPVYSTILKSRSNVDLKDKWRNISVTALWGSRKKAKLALKRTPLSGSRQDDNATAITIVSLANGDVGGQQIDAPSPPAGSCEPPRPSTSVDKIILEAITSLKRPFGPDGKSILMYIEENFKMQPDMKRLVTSRLKYLTNVGTLVKKKHKYRISQNYMAEGEGQRSPQLLLEGNKENTPKPEENGVKNLTKSQVGGEVMIMGMTEKEAAAAAARAVAEAEFAMAEAEEAAREADKAEAEAEAAHIFAKAAMKAVKYRMHSQTR

SEQ ID NO: 121 - DNA, 1068 bp, Arabidopsis thaliana
  CDS (1)..(1068)
atgaatatcgtctcttggaaagatgcaaacgacgaagttgcaggcggcgctacgacaagacgtgaaagagaagtaaaagaggatcaagaagaaaccgaagtcagagccaccagtggcaaaaccgtaattaaaaagcagcctacatcgatctcttcttcttcttcttcgtggatgaaatccaaggatccgaggattgttagggtttcacgcgcctttggaggcaaagaccgtcacagcaaagtgtgtacgttacgtggactacgtgacagacgcgtgagattatcagtcccaacggctattcagctctacgatcttcaagaacggctcggtgttgaccagcctagcaaagccgttgactggttgcttgatgcagctaaagaggagatcgacgagctacctccgttacctatctcgccggaaaatttcagcatcttcaaccatcatcagtccttcttgaatcttggtcaacggcccggtcaagatccgacccaactcgggtttaaaatcaatggatgtgtacaaaagtctactactactagccgcgaagaaaacgatagagagaaaggagaaaacgatgtcgtttacacaaacaatcatcatgttgggtcttatggaacttatcacaacctggaacatcatcatcatcatcaccaacatttgagtttacaggcagattatcatagtcatcaactacatagtcttgtcccatttccatcacaaattttggtatgtccaatgacgacatcaccaacaactacaactatacaatctttgtttccatcatcatcgtcagctggttcagggactatggagacattagatccgaggcaaatggtaagccattttcaaatgccattaatgggtaattcttcatcttcgtcttcccaaaacatttcgacattatattcgttgttacatggtagtagtagcaacaatggtggtagagacattgataatcggatgtcgtcggtccaattcaaccgaactaatagcactacaacggctaacatgtcgaggcatctaggctcggagcgttgtacaagtagaggaagtgatcaccatatgtga

SEQ ID NO: 122 - protein, 355 aa, Arabidopsis thaliana
MNIVSWKDANDEVAGGATTRREREVKEDQEETEVRATSGKTVIKKQPTSISSSSSSWMKSKDPRIVRVSRAFGGKDRHSKVCTLRGLRDRRVRLSVPTAIQLYDLQERLGVDQPSKAVDWLLDAAKEEIDELPPLPISPENFSIFNHHQSFLNLGQRPGQDPTQLGFKINGCVQKSTTTSREENDREKGENDVVYTNNHHVGSYGTYHNLEHHHHHHQHLSLQADYHSHQLHSLVPFPSQILVCPMTTSPTTTTIQSLFPSSSSAGSGTMETLDPRQMVSHFQMPLMGNSSSSSSQNISTLYSLLHGSSSNNGGRDIDNRMSSVQFNRTNSTTTANMSRHLGSERCTSRGSDHHM

SEQ ID NO: 123 - DNA, 732 bp, Arabidopsis thaliana
  CDS (1)..(732)
atgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataa

SEQ ID NO: 124 - protein, 243 aa, Arabidopsis thaliana
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 125 - DNA, 1260 bp, Arabidopsis thaliana
  CDS (1)..(1260)
atggagtgtaatgcaaagccaccgtttcaatgggaattggaaaacttgatatcttttggcacttctacagctgaagttcctagaaagctaaaaccaatggagtgggaaattgatggatttgattgcacctctctgtattcttcaagctttgcctatgctggtagttcaggttctgatatagctcatgctttctctaaaagctcaaagtcaacttccattagctcttcatcagctgaagtaagaacacacaattttacatccgaaactggtgaaagtcttcctggagaatttgcaaaggggattgatacttctccaagtcttgaactttcttttggctctggtgatccggttctcggtttaaagcttggtaaacgaacgtactttgaagacttttgggaagtggagaatgctaaaggtttgggacttccagtgactctggcttcatcttctgtttctcccgtgaagaaatcgaaatccattcctcagaggttacaaactcctcactgtcaagttgaaggctgtaatcttgatctttcatcagctaaagactatcatcggaaacataggatttgtgaaaatcattcaaagtttcctaaagtcgttgtgagtggcgtagagcgtcggttctgccaacaatgtagcaggttccactgtctctctgagtttgatgagaagaaacgtagctgtcgccgacgtctctcagatcacaatgcaagacgtcgcaagccaaatcctggaaggacatatgatgggaaaccacaggtggattttgtatggaacagatttgcacttatccatccaagaagtgaggaaaagtttatatggccaagttcgaagcacgtaccatcaagagtgttaatgccgcaacctgcaaagactgagatttccgataccgagcacaatagatttggattgttggaccccaaaaccaaaaccgcaagagccgagttattcagtaaagaaaaggtcacaatctcttcacacatgggtgcttctcaagatcttgatggtgctctctctcttctgtcaaattcaacaacatgggtttcttcctctgaccaaccaaggcgttttacccttgatcaccatccctcaagcaacctccaacccgtagctcaccggtctgcggctcaactcaattcagtttccggctattggcagccggacccacccgcagttgaaggcccgaccgctctgcatagaaatggggtaggccagtttaatgaaaactacttcagcttgaaccagttttataactga

SEQ ID NO: 126 - protein, 419 aa, Arabidopsis thaliana
MECNAKPPFQWELENLISFGTSTAEVPRKLKPMEWEIDGFDCTSLYSSSFAYAGSSGSDIAHAFSKSSKSTSISSSSAEVRTHNFTSETGESLPGEFAKGIDTSPSLELSFGSGDPVLGLKLGKRTYFEDFWEVENAKGLGLPVTLASSSVSPVKKSKSIPQRLQTPHCQVEGCNLDLSSAKDYHRKHRICENHSKFPKVVVSGVERRFCQQCSRFHCLSEFDEKKRSCRRRLSDHNARRRKPNPGRTYDGKPQVDFVWNRFALIHPRSEEKFIWPSSKHVPSRVLMPQPAKTEISDTEHNRFGLLDPKTKTARAELFSKEKVTISSHMGASQDLDGALSLLSNSTTWVSSSDQPRRFTLDHHPSSNLQPVAHRSAAQLNSVSGYWQPDPPAVEGPTALHRNGVGQFNENYFSLNQFYN

SEQ ID NO: 127 - DNA, 699 bp, Arabidopsis thaliana
  CDS (1)..(699)
atgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatga

SEQ ID NO: 128 - protein, 232 aa, Arabidopsis thaliana
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 129 - DNA, 807 bp, Arabidopsis thaliana
  CDS (1)..(807)
atggaagtaacttcccaatctaccctccctccagggttcagatttcatcctaccgacgaagaactcatcgtttactatcttcgaaaccagaccatgtctaaaccatgccctgtctccatcatcccagaagttgatatctacaaattcgacccatggcaattacccgagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcaagtaacgtaggtgtcaagaaagctctagtcttctacaaaggtagacctcctaaaggaatcaaaactgactggatcatgcatgagtatcgtctccatgattcacgtaaagcatcaacgaaacgtaacggttccatgaggttagatgaatgggtactgtgtaggatatacaagaagagaggagcaagtaagcttctgaatgagcaagagggtttcatggacgaagtactaatggaggatgagacaaaagttgtagttaacgaagcagagagaagaactgaagaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggaccttcagtttaaccaagacgagatcttaaaccatcatcgtcaagcgatgtttaagttttag

SEQ ID NO: 130 - protein, 268 aa, Arabidopsis thaliana
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRNGSMRLDEWVLCRIYKKRGASKLLNEQEGFMDEVLMEDETKVVVNEAERRTEEEIMMMTSMKLPRTCSLAHLLEMDYMGPVSHIDNFSQFDHLHQPDSESSWFGDLQFNQDEILNHHRQAMFKF

SEQ ID NO: 131 - DNA, 849 bp, Arabidopsis thaliana
  CDS (1)..(849)
atgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataa

SEQ ID NO: 132 - protein, 282 aa, Arabidopsis thaliana
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 133 - DNA, 759 bp, Arabidopsis thaliana
  CDS (1)..(759)
atgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtttcaacaacattactacgtgcaaggtgaagggtcttcggtatcaaagagtaacgtggcaggtgagactaatttcgtccaaggttgggttctttga

SEQ ID NO: 134 - protein, 252 aa, Arabidopsis thaliana
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 135 - DNA, 1200 bp, Arabidopsis thaliana
  CDS (1)..(1200)
atggttttttcttcatttcctacttatcctgatcattcatcaaactggcaacaacaacatcaaccaatcacaaccaccgttggattcacgggaaataacatcaaccaacagtttcttcctcaccatcccctcccaccgcaacagcaacaaacgcctccgcagcttcaccacaacaacggtaacggcggagtcgctgttcccggtggacctggcgggttaatccgaccaggttcgatggcggaaagagcaaggctagccaacataccattacctgaaacagccttgaagtgtccaagatgtgactcaactaacaccaaattctgttacttcaacaactacagtctcactcaacctcgccacttctgcaaagcatgccgtcgttactggacacgtggcggtgctctaaggagcgttcccgtcggtggcggttgccgtagaaacaaaagaaccaaaaacagcagcggtggaggtggcggtagcaccagtagcggtaacagcaagtcacaagacagcgccacgagcaacgaccaataccaccaccgagccatggctaacaatcagatgggaccaccttcttcgtcatcgtctctaagctcgttgctgtcttcttacaacgcagggttaatccccggacatgatcataacagcaataacaacaacatacttggacttggatcatctttgcctcctcttaagcttatgcctcctttagacttcacagacaacttcaccttacaatacggtgccgtttcagctccttcttatcatataggcggtggaagcagtggaggagcggcggctcttttaaacggttttgaccagtggagattcccggcaacaaaccaacttcctttaggcggtttagacccgtttgatcaacaacatcaaatggagcagcagaatccaggttacggattggttaccgggtcgggtcagtatcgacctaagaacattttccataaccttatctcctcttcttcgtctgcttcatcagctatggttacagccaccgcgtcgcaattagcttcagtgaaaatggaagatagtaacaatcagctcaacttgtctagacaactttttggagacgaacaacagctctggaatattcatggcgctgctgcagcatccaccgcagctgcaacaagttcgtggagtgaagtctctaataatttcagttcttcttctactagcaatatataa

SEQ ID NO: 136 - protein, 399 aa, Arabidopsis thaliana
MVFSSFPTYPDHSSNWQQQHQPITTTVGFTGNNINQQFLPHHPLPPQQQQTPPQLHHNNGNGGVAVPGGPGGLIRPGSMAERARLANIPLPETALKCPRCDSTNTKFCYFNNYSLTQPRHFCKACRRYWTRGGALRSVPVGGGCRRNKRTKNSSGGGGGSTSSGNSKSQDSATSNDQYHHRAMANNQMGPPSSSSSLSSLLSSYNAGLIPGHDHNSNNNNILGLGSSLPPLKLMPPLDFTDNFTLQYGAVSAPSYHIGGGSSGGAAALLNGFDQWRFPATNQLPLGGLDPFDQQHQMEQQNPGYGLVTGSGQYRPKNIFHNLISSSSSASSAMVTATASQLASVKMEDSNNQLNLSRQLFGDEQQLWNIHGAAAASTAAATSSWSEVSNNFSSSSTSNI

SEQ ID NO: 137 - DNA, 1188 bp, Arabidopsis thaliana
  CDS (1)..(1188)
atgaattcattttcccacgtccctccgggttttagatttcacccgacagatgaagaacttgtagactactacctgaggaaaaaagtcgcatcgaagagaatagaaattgatttcataaaggacattgatctttacaagattgagccatgggaccttcaagagttgtgcaaaattgggcatgaagagcagagtgattggtacttctttagccataaagacaagaagtatcccacagggactcgaaccaatagagcaacaaaagcagggttttggaaagccaccggaagagataaggctatctatttgaggcatagtctaattggcatgaggaaaacacttgtgttttacaagggaagagccccaaatggacaaaagtctgattggatcatgcacgaataccgcttagaaaccgatgaaaacggaactcctcaggaagaaggatgggttgtgtgtagggttttcaagaagagattggctgcagttagacgaatgggagattacgactcatccccttcacattggtacgatgatcaactttcttttatggcctccgagctcgagacaaacggtcaacgacggattctccccaatcatcatcagcagcagcagcacgagcaccaacaacatatgccatatggcctcaatgcatctgcttacgctctcaacaaccctaacttgcaatgcaagcaagagctagaactacactacaaccacctggtacaacgaaatcatcttcttgatgaatctcatttatcgttcctccaacttcctcaactagaaagccctaagattcaacaagataacagtaattgcaactctcttccttatggaacaagcaacatcgataataactcgagccataatgctaacttgcagcaatcaaatatcgcgcatgaggaacaattgaatcaaggaaatcagaacttcagctctctatacatgaacagcggcaacgagcaagtgatggaccaagtcacagactggagagttctcgataaatttgttgcttctcagctaagcaacgaggaggctgccacagcttctgcatctatacagaataatgccaaggacacaagcaatgctgagtaccaagttgatgaagaaaaagatccgaaaagggcttcagacatgggagaagaatatactgcttctacttcttcgagttgtcagattgatctatggaagtga

SEQ ID NO: 138 - protein, 395 aa, Arabidopsis thaliana
MNSFSHVPPGFRFHPTDEELVDYYLRKKVASKRIEIDFIKDIDLYKIEPWDLQELCKIGHEEQSDWYFFSHKDKKYPTGTRTNRATKAGFWKATGRDKAIYLRHSLIGMRKTLVFYKGRAPNGQKSDWIMHEYRLETDENGTPQEEGWVVCRVFKKRLAAVRRMGDYDSSPSHWYDDQLSFMASELETNGQRRILPNHHQQQQHEHQQHMPYGLNASAYALNNPNLQCKQELELHYNHLVQRNHLLDESHLSFLQLPQLESPKIQQDNSNCNSLPYGTSNIDNNSSHNANLQQSNIAHEEQLNQGNQNFSSLYMNSGNEQVMDQVTDWRVLDKFVASQLSNEEAATASASIQNNAKDTSNAEYQVDEEKDPKRASDMGEEYTASTSSSCQIDLWK

SEQ ID NO: 139 - DNA, 639 bp, Arabidopsis thaliana
  CDS (1)..(639)
atggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataa

SEQ ID NO: 140 - protein, 212 aa, Arabidopsis thaliana
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 141 - DNA, 234 bp, Arabidopsis thaliana
  CDS (1)..(234)
atggataaccatcgcaggactaagcaacccaagaccaactccatcgttacttcttcttctgaaggaacagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 142 - protein, 77 aa, Arabidopsis thaliana
MDNHRRTKQPKTNSIVTSSSEGTEVSSLEWEVVNMSQEEEDLVSRMHKLVGDRWELIAGRIPGRTAGEIERFWVMKN

SEQ ID NO: 143 - DNA, 1110 bp, Arabidopsis thaliana
  CDS (1)..(1110)
atggacgctacgaagtggacacagggttttcaagaaatgatgaacgttaaaccaatggagcagatcatgattcctaataacaacacacatcaaccaaacaccacatccaatgcaaggccaaacaccattctcacatctaacggcgtctcaactgctggagcaaccgtctccggcgtaagcaacaacaataacaatacggcggttgtggcggagaggaaagcaagaccacaagagaaactaaattgtccaagatgcaactcaaccaacacaaagttttgttactacaacaactatagtctcacacaaccaagatacttctgcaaaggttgtcgaaggtattggaccgaaggtggatctcttaggaatgttcctgtgggaggaagctcaagaaagaacaagagatcatcttcatcttcttcatcaaacatccttcagacaataccatcttcacttccagatctaaacccgccaatactcttctcaaaccaaatccataataaatcgaaagggtcatcacaagatctcaacttgttgtctttcccagtcatgcaagatcaacatcatcatcatgtccatatgtctcagtttcttcagatgcctaagatggagggaaatggtaacataactcatcagcagcagccttcatcatcttcttctgtctatggttcctcgtcgtctcctgtttcagctcttgaacttttaagaaccggagttaatgtttcttcaagatcagggattaactcatcgttcatgccttccggttcaatgatggattcaaacactgtgctttacacttcttcagggtttccaacaatggtggattacaagccaagtaatctctccttctctaccgatcatcaagggcttggacacaatagcaacaataggtctgaagctcttcatagtgatcatcaccaacaaggtagagttttgtttccatttggggatcaaatgaaggagctttcatcaagcataacacaagaagttgatcatgatgataatcaacaacagaagagtcatggaaataataataataataataactcaagccctaataatggatattggagtgggatgttcagtactacaggaggaggatcttcatggtga

SEQ ID NO: 144 - protein, 369 aa, Arabidopsis thaliana
MDATKWTQGFQEMMNVKPMEQIMIPNNNTHQPNTTSNARPNTILTSNGVSTAGATVSGVSNNNNNTAVVAERKARPQEKLNCPRCNSTNTKFCYYNNYSLTQPRYFCKGCRRYWTEGGSLRNVPVGGSSRKNKRSSSSSSSNILQTIPSSLPDLNPPILFSNQIHNKSKGSSQDLNLLSFPVMQDQHHHHVHMSQFLQMPKMEGNGNITHQQQPSSSSSVYGSSSSPVSALELLRTGVNVSSRSGINSSFMPSGSMMDSNTVLYTSSGFPTMVDYKPSNLSFSTDHQGLGHNSNNRSEALHSDHHQQGRVLFPFGDQMKELSSSITQEVDHDDNQQQKSHGNNNNNNNSSPNNGYWSGMFSTTGGGSSW

SEQ ID NO: 145 - DNA, 771 bp, Arabidopsis thaliana
  CDS (1)..(771)
atgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataagggaaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcagaaccaaggccacaatatgcctccccctctgccaccgcagcagcaccaaatccagcatccttacatgctctctcatcagccatctccttttctcaacatgggtggtctgtatcaagaagatgatcctatggcaatgaggaggaatgatctcgaactgactcttgaacccgtttacaactgcaaccttggctgcttcgccgcatga

SEQ ID NO: 146 - protein, 256 aa, Arabidopsis thaliana
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 147 - DNA, 762 bp, Arabidopsis thaliana
  CDS (1)..(762)
atgatgaaatctggggctgatttgcaatttccaccaggatttagatttcatcctacggatgaggagctagtcctcatgtatctctgtcgtaaatgcgcgtcgcagccgatccctgctccgattatcaccgaactcgatttgtaccgatatgatccttgggaccttcccgacatggctttgtacggtgaaaaggagtggtattttttctcaccaagagatcgaaagtatccaaacggttcaagacccaaccgtgcagctggtactggatattggaaagctaccggagctgataaaccaataggtcgtcctaaaccggttggtattaagaaggctctagtgttttactcgggaaaacctccaaatggagagaaaaccaattggattatgcacgaataccggctcgctgacgttgaccggtcggttcgtaagaaaaacagtctaagattggacgattgggtattgtgtcgtatatataacaagaaaggtgtcatcgagaagcgacgaagcgatatcgaggacgggttaaagcctgtgactgacacgtgtccaccggaatctgtggcgagattgatctccggctcggagcaagcggtgtcaccggaattcacgtgtagcaacggtcggttgagtaatgcccttgattttccgtttaattacgtagatgccatcgccgataacgagattgtgtcacggctattgggcgggaatcagatgtggtcgacgacgcttgatccacttgtggttaggcagggaactttctga

SEQ ID NO: 148 - protein, 253 aa, Arabidopsis thaliana
MMKSGADLQFPPGFRFHPTDEELVLMYLCRKCASQPIPAPIITELDLYRYDPWDLPDMALYGEKEWYFFSPRDRKYPNGSRPNRAAGTGYWKATGADKPIGRPKPVGIKKALVFYSGKPPNGEKTNWIMHEYRLADVDRSVRKKNSLRLDDWVLCRIYNKKGVIEKRRSDIEDGLKPVTDTCPPESVARLISGSEQAVSPEFTCSNGRLSNALDFPFNYVDAIADNEIVSRLLGGNQMWSTTLDPLVVRQGTF

SEQ ID NO: 149 - DNA, 1884 bp, Arabidopsis thaliana
  CDS (1)..(1884)
atgggtttagctactacaacttcttctatgtcacaagattatcatcatcaccaaggaatcttttccttctctaatggattccaccgatcatcatcaaccactcatcaagaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttag

SEQ ID NO: 150 - protein, 627 aa, Arabidopsis thaliana
MGLATTTSSMSQDYHHHQGIFSFSNGFHRSSSTTHQEEVDESAVVSGAQIPVYETAGMLSEMFAYPGGGGGGSGGEILDQSTKQLLEQQNRHNNNNNSTLHMLLPNHHQGFAFTDENTMQPQQQQHFTWPSSSSDHHQNRDMIGTVHVEGGKGLSLSLSSSLAAAKAEEYRSIYCAAVDGTSSSSNASAHHHQFNQFKNLLLENSSSQHHHHQVVGHFGSSSSSPMAASSSIGGIYTLRNSKYTKPAQELLEEFCSVGRGHFKKNKLSRNNSNPNTTGGGGGGGSSSSAGTANDSPPLSPADRIEHQRRKVKLLSMLEEVDRRYNHYCEQMQMVVNSFDQVMGYGAAVPYTTLAQKAMSRHFRCLKDAVAVQLKRSCELLGDKEAAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEAEEENENQQQQRRQQQTNNNDTKPNNNENNFTVITAQTPTTMTSTHHENDSSFLSSVAAASHGGSDAFTVATCQQDVSDFHVDGDGVNVIRFGTKQTGDVSLTLGLRHSGNIPDKNTSFSVRDFGDF

SEQ ID NO: 151 - DNA, 1809 bp, Arabidopsis thaliana
  CDS (1)..(1809)
atggctgcttcttcatcctccgctgcttccttctttggagtccgacaagatgaccaatctcacctcctcccacctaattcctccgccgctgctcctcctcctccacctcctcaccaccaggcaccgctgccaccgcttgaagctccaccgcagaaaaagaagagaaaccaaccaagaactccaaattccgatgcggaagtgatagctttatctccaaagacactaatggctacaaacagattcatatgtgaagtatgcaacaaagggtttcaaagagaacagaatctacaacttcaccgaagaggacacaatcttccatggaagctcaaacagaaatcgaccaaagaagtgaagagaaaagtgtatctttgtccggagccctcgtgcgtccaccatgacccgtcacgtgctctcggagacctcaccggaatcaagaaacattattaccgtaaacacggtgaaaagaagtggaaatgcgataaatgctctaagcgttacgctgttcaatcggattggaaagctcactccaagacttgtggtaccaaagagtatcgttgtgactgtggtacactcttctctcggcgagacagtttcatcacacatagagctttctgtgacgcgttggctcaagagagtgcgagacacccaacttcattgacttctttgccaagtcatcacttcccgtacggacaaaacacaaacaactccaacaacaacgcttcaagcatgatccttggtctgtcccacatgggggccccacagaatcttgatcaccagcccggtgacgttctccgtcttggaagcggaggaggaggaggaggagccgcttcacgctcttcttctgatctcattgctgcgaatgcttcaggctacttcatgcaagagcaaaaccctagctttcatgatcaacaagatcatcatcatcatcatcaacaagggtttttggctgggaacaataacatcaagcaatcaccaatgagttttcaacagaatctgatgcagttctcacatgataaccataattctgctccctccaatgtcttcaatctcagcttcctctccggaaacaacggagttacttctgccacaagtaaccctaatgctgccgccgctgctgctgtttcttctggtaatcttatgatatcaaaccattatgatggcgaaaatgctgttggaggaggaggagaaggaagcactggtctcttccctaacaatctgatgagctcggcagatagaattagctcaggatcagtcccttcactctttagctcatcaatgcaaagtccaaattcagcacctcacatgtcagccactgcccttctacagaaagctgctcaaatgggttcaacctcaagcaacaacaacaacggaagcaacaccaacaacaataacaatgcctcatcgatcctaagaagctttgggagtggaatctacggagaaaatgagagtaatcttcaggatttgatgaattctttctctaaccccggcgcaacgggaaacgttaacggagttgattctccttttggttcgtacggaggagtgaacaaaggattaagcgctgacaaacagagcatgactagagactttcttggagttggacagatcgtaaaaagcatgagtggaagcggagggtttcaacaacagcaacaacagcaacagcagcaacaacaacaacaacaacatggaaatagtagagaaagagttggctcgtcgtcggattccgctgatagaagcagcatgaatgtgaataccggaggtggtccggcaagtacttcaccaccttatggaatccatcatgcgagtttctaa

SEQ ID NO: 152 - protein, 602 aa, Arabidopsis thaliana
MAASSSSAASFFGVRQDDQSHLLPPNSSAAAPPPPPPHHQAPLPPLEAPPQKKKRNQPRTPNSDAEVIALSPKTLMATNRFICEVCNKGFQREQNLQLHRRGHNLPWKLKQKSTKEVKRKVYLCPEPSCVHHDPSRALGDLTGIKKHYYRKHGEKKWKCDKCSKRYAVQSDWKAHSKTCGTKEYRCDCGTLFSRRDSFITHRAFCDALAQESARHPTSLTSLPSHHFPYGQNTNNSNNNASSMILGLSHMGAPQNLDHQPGDVLRLGSGGGGGGAASRSSSDLIAANASGYFMQEQNPSFHDQQDHHHHHQQGFLAGNNNIKQSPMSFQQNLMQFSHDNHNSAPSNVFNLSFLSGNNGVTSATSNPNAAAAAAVSSGNLMISNHYDGENAVGGGGEGSTGLFPNNLMSSADRISSGSVPSLFSSSMQSPNSAPHMSATALLQKAAQMGSTSSNNNNGSNTNNNNNASSILRSFGSGIYGENESNLQDLMNSFSNPGATGNVNGVDSPFGSYGGVNKGLSADKQSMTRDFLGVGQIVKSMSGSGGFQQQQQQQQQQQQQQQHGNSRERVGSSSDSADRSSMNVNTGGGPASTSPPYGIHHASF

SEQ ID NO: 153 - DNA, 774 bp, Arabidopsis thaliana
  CDS (1)..(774)
atgggaagatcaccatgctgcgagaaagctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattag

SEQ ID NO: 154 - protein, 257 aa, Arabidopsis thaliana
MGRSPCCEKAHMNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIKNYWNTHIKRKLLSRGIDPNSHRLINESVVSPSSLQNDVVETIHLDFSGPVKPEPVREEIGMVNNCESSGTTSEKDYGNEEDWVLNLELSVGPSYRYESTRKVSVVDSAESTRRWGSELFGAHESDAVCLCCRIGLFRNESCRNCRVSDVRTH

SEQ ID NO: 155 - DNA, 708 bp, Arabidopsis thaliana
  CDS (1)..(708)
atggccgatgaggtcacaatcgggtttcgcttctatcccacggaagaagaactggtttcgttctacctacgaaaccagctcgaaggaaggagtgatgactcaatgcatcgtgtcattcccgtacttgacgtctttgaggtcgagcctagtcatcttccaaatgttgctggagtgagatgtcgaggagacgctgagcaatggttcttcttcgtgccacgacaagaacgcgaagcaagaggaggcagaccgagtagaactactggttcaggatactggaaagcaactggatcacctggtccagtcttttccaaagacaacaaaatgattggagcaaagaaaactatggttttctacactggaaaagcacccacaggaagaaaaactaaatggaaaatgaatgagtaccacgccgttgacgaaacagtcaacgcttccacaatccctaagctgagacgtgagttcagtttatgtcgagtctacataacaacaggaagctccagagcttttgatagacgtcctgagggagttttgcagacagagagaatgctaacaagtgatgttgcagtagctgagacatcgttccgtgtggaaagctcactggaaacttcgatttcaggaggagaacatattgatgtctctatgaacacagagtttgttgatggactatcagaaccgatgtgggactgggaacagctgacttggccttga

SEQ ID NO: 156 - protein, 235 aa, Arabidopsis thaliana
MADEVTIGFRFYPTEEELVSFYLRNQLEGRSDDSMHRVIPVLDVFEVEPSHLPNVAGVRCRGDAEQWFFFVPRQEREARGGRPSRTTGSGYWKATGSPGPVFSKDNKMIGAKKTMVFYTGKAPTGRKTKWKMNEYHAVDETVNASTIPKLRREFSLCRVYITTGSSRAFDRRPEGVLQTERMLTSDVAVAETSFRVESSLETSISGGEHIDVSMNTEFVDGLSEPMWDWEQLTWP

SEQ ID NO: 157 - DNA, 1047 bp, Arabidopsis thaliana
  CDS (1)..(1047)
atggaaagtctcgcacacattcctcccggttatcgattccatccgaccgatgaagaactcgttgactattatctcaagaacaaagttgcattcccgggaatgcaagttgatgttatcaaagatgttgatctctacaaaatcgagccatgggacatccaagagttatgtggaagagggacaggagaagagagggaatggtatttctttagccacaaggacaagaaatatccaactgggacacgaaccaatagagcaacgggctccggattttggaaagcaacgggtcgagacaaggccatttactcaaagcaagagcttgttgggatgaggaagactcttgtcttttacaaaggtagggccccaaatggtcagaaatctgattggataatgcacgaataccgtcttgagaccgatgaaaatggaccgcctcatgaggaaggatgggtggtttgtcgcgctttcaagaagaagctaaccacgatgaactacaacaatccaagaacaatgatgggatcatcatcaggccaagaatctaactggttcacgcagcaaatggatgtggggaatggtaattactatcatcttcctgatctagagagtccgagaatgtttcaaggctcatcatcatcatcactatcatcattacatcagaatgatcaagacccttatggtgtcgtactcagcactattaacgcaaccccaactacaataatgcaacgagatgatggtcatgtgattaccaatgatgatgatcatatgatcatgatgaacacaagtactggtgatcatcatcaatcaggattactagtcaatgatgatcataatgatcaagtaatggattggcaaacgcttgacaagtttgttgcttctcagctaatcatgagccaagaagaggaagaagttaacaaagatccatcagataattcttcgaatgaaacatttcatcatctctctgaagagcaagctgcaacaatggtttcgatgaatgcttcttcctcttcttctccatgttccttctactcttgggctcaaaatacacacacgtaa

SEQ ID NO: 158 - protein, 348 aa, Arabidopsis thaliana
MESLAHIPPGYRFHPTDEELVDYYLKNKVAFPGMQVDVIKDVDLYKIEPWDIQELCGRGTGEEREWYFFSHKDKKYPTGTRTNRATGSGFWKATGRDKAIYSKQELVGMRKTLVFYKGRAPNGQKSDWIMHEYRLETDENGPPHEEGWVVCRAFKKKLTTMNYNNPRTMMGSSSGQESNWFTQQMDVGNGNYYHLPDLESPRMFQGSSSSSLSSLHQNDQDPYGVVLSTINATPTTIMQRDDGHVITNDDDHMIMMNTSTGDHHQSGLLVNDDHNDQVMDWQTLDKFVASQLIMSQEEEEVNKDPSDNSSNETFHHLSEEQAATMVSMNASSSSSPCSFYSWAQNTHT

SEQ ID NO: 159 - DNA, 25 bp, Artificial Sequence
  Synthetic polynucleotide
gatggaggatcaagttgggtttggg

SEQ ID NO: 160 - DNA, 25 bp, Artificial Sequence
  Synthetic polynucleotide
accaacaagaatgatccaactaatg

SEQ ID NO: 161 - DNA, 22 bp, Artificial Sequence
  Synthetic polynucleotide
atgtcaccacagagaatgaagc

SEQ ID NO: 162 - DNA, 22 bp, Artificial Sequence
  Synthetic polynucleotide
cagacacgccatgaactgatac

SEQ ID NO: 163 - DNA, 30 bp, Artificial Sequence
  Synthetic polynucleotide
gatggggagacattcttgctgttacaaaca

SEQ ID NO: 164 - DNA, 30 bp, Artificial Sequence
  Synthetic polynucleotide
aagggactgaccaaaagagacggccattct

SEQ ID NO: 165 - DNA, 32 bp, Artificial Sequence
  Synthetic polynucleotide
gggatggcgttcgcaggaacaacccagaaatg

SEQ ID NO: 166 - DNA, 25 bp, Artificial Sequence
  Synthetic polynucleotide
agcagcgacgactttgtccttggcg

SEQ ID NO: 167 - DNA, 30 bp, Artificial Sequence
  Synthetic polynucleotide
gatgaattcattttcccacgtccctccggg

SEQ ID NO: 168 - DNA, 30 bp, Artificial Sequence
  Synthetic polynucleotide
cttccatagatcaatctgacaactcgaaga

SEQ ID NO: 169 - DNA, 23 bp, Artificial Sequence
  Synthetic polynucleotide
atgttgaaatcaagtaacaagag

SEQ ID NO: 170 - DNA, 21 bp, Artificial Sequence
  Synthetic polynucleotide
cataagaaactgtggagcatc

SEQ ID NO: 171 - DNA, 25 bp, Artificial Sequence
  Synthetic polynucleotide
aatggaaaaagccttgagaaacttc

SEQ ID NO: 172 - DNA, 24 bp, Artificial Sequence
  Synthetic polynucleotide
tccccacgatcttcggcaagtaca

SEQ ID NO: 173 - DNA, 20 bp, Artificial Sequence
  Synthetic polynucleotide
atggaaggaattcagcatcc

SEQ ID NO: 174 - DNA, 20 bp, Artificial Sequence
  Synthetic polynucleotide
ggctttcattttcttgctgg

SEQ ID NO: 175 - DNA, 23 bp, Artificial Sequence
  Synthetic polynucleotide
atggtacagacgaagaagttcag

SEQ ID NO: 176 - DNA, 25 bp, Artificial Sequence
  Synthetic polynucleotide
gtttgtattgagaagctcctctatc

SEQ ID NO: 177 - DNA, 30 bp, Artificial Sequence
  Synthetic polynucleotide
gatgggaaatcagaagctcaaatggacggc

SEQ ID NO: 178 - DNA, 30 bp, Artificial Sequence
  Synthetic polynucleotide
attcaagtacataatctttccctgactaca

SEQ ID NO: 179 - DNA, 30 bp, Artificial Sequence
  Synthetic polynucleotide
gatggccgctgaggatcgaagtgaggaact

SEQ ID NO: 180 - DNA, 30 bp, Artificial Sequence
  Synthetic polynucleotide
gcatatacgtgctctttggcttttcttttc

SEQ ID NO: 181 - DNA, 30 bp, Artificial Sequence
  Synthetic polynucleotide
gatggtgcggacaccgtgttgcaaagctga

SEQ ID NO: 182 - DNA, 30 bp, Artificial Sequence
  Synthetic polynucleotide
tccaaaatagttatcaatttcgtcaaacaa

SEQ ID NO: 183 - DNA, 30 bp, Artificial Sequence
  Synthetic polynucleotide
gatggagttggagcctatatcatcgagttg

SEQ ID NO: 184 - DNA, 30 bp, Artificial Sequence
  Synthetic polynucleotide
tccgacctgcatccgacattgacggccatg

SEQ ID NO: 185 - DNA, 30 bp, Artificial Sequence
  Synthetic polynucleotide
gatgggaagatcaccatgctgcgagaaagc

SEQ ID NO: 186 - DNA, 30 bp, Artificial Sequence
  Synthetic polynucleotide
atgagttctaacatcagaaacccgacaatt

SEQ ID NO: 187 - DNA, 27 bp, Artificial Sequence
  Synthetic polynucleotide
atgaaacgaattgttcgaatttcattc

SEQ ID NO: 188 - DNA, 23 bp, Artificial Sequence
  Synthetic polynucleotide
aacaacttcttcagaagcaccac

SEQ ID NO: 189 - DNA, 30 bp, Artificial Sequence
  Synthetic polynucleotide
gatgggaagagggagagtagaattgaagag

SEQ ID NO: 190 - DNA, 30 bp, Artificial Sequence
  Synthetic polynucleotide
aatagagttggtgtcataaggtaaccaacc

SEQ ID NO: 191 - DNA, 22 bp, Artificial Sequence
  Synthetic polynucleotide
atggaagaagcaatcatgagac

SEQ ID NO: 192 - DNA, 24 bp, Artificial Sequence
  Synthetic polynucleotide
ataatcatcatgaaagcaatactg

SEQ ID NO: 193 - DNA, 21 bp, Artificial Sequence
  Synthetic polynucleotide
atgtcggctgtgtctgaatcg

SEQ ID NO: 194 - DNA, 20 bp, Artificial Sequence
  Synthetic polynucleotide
aaccaaaccgagaggcggtg

SEQ ID NO: 195 - DNA, 25 bp, Artificial Sequence
  Synthetic polynucleotide
gatggctgggcgatcatggctgatc

SEQ ID NO: 196 - DNA, 23 bp, Artificial Sequence
  Synthetic polynucleotide
cagcagcgtggcagtgtgttgcc

SEQ ID NO: 197 - DNA, 30 bp, Artificial Sequence
  Synthetic polynucleotide
gatggactgcaacatggtatcttcgtccca

SEQ ID NO: 198 - DNA, 30 bp, Artificial Sequence
  Synthetic polynucleotide
ttttggtacaacatcatatgaacagagtag

SEQ ID NO: 199 - DNA, 30 bp, Artificial Sequence
  Synthetic polynucleotide
gatggactgcaacatggtatcttcgttccc

SEQ ID NO: 200 - DNA, 30 bp, Artificial Sequence
  Synthetic polynucleotide
gatgaaatgactagggaaagtgccaaatat

SEQ ID NO: 201 - DNA, 30 bp, Artificial Sequence
  Synthetic polynucleotide
gatggcgctcgaggctcttacatcaccaag

SEQ ID NO: 202 - DNA, 30 bp, Artificial Sequence
  Synthetic polynucleotide
aagttgaagtttgaccggaaagtcaaaccg

SEQ ID NO: 203 - DNA, 25 bp, Artificial Sequence
  Synthetic polynucleotide
atggagttcaatggtaatttgaatg

SEQ ID NO: 204 - DNA, 21 bp, Artificial Sequence
  Synthetic polynucleotide
ttggtagaagaatgtggaggg

SEQ ID NO: 205 - DNA, 24 bp, Artificial Sequence
  Synthetic polynucleotide
gatgacggggaagcgatcaaagac

SEQ ID NO: 206 - DNA, 26 bp, Artificial Sequence
  Synthetic polynucleotide
ggggatataatagtcgcttagatttc

SEQ ID NO: 207 - DNA, 22 bp, Artificial Sequence
  Synthetic polynucleotide
atggaggttgacgaagacattg

SEQ ID NO: 208 - DNA, 21 bp, Artificial Sequence
  Synthetic polynucleotide
tctcctttcctttgccttgtc

SEQ ID NO: 209 - DNA, 30 bp, Artificial Sequence
  Synthetic polynucleotide
gatggaaaatcctccattagaatctgagat

SEQ ID NO: 210 - DNA, 30 bp, Artificial Sequence
  Synthetic polynucleotide
catcaaatctactccgaaaagttttccttt

SEQ ID NO: 211 - DNA, 30 bp, Artificial Sequence
  Synthetic polynucleotide
gatggctgataataaggtcaatctttcgat

SEQ ID NO: 212 - DNA, 30 bp, Artificial Sequence
  Synthetic polynucleotide
tacagataaatgaagaagtgggtctaaaga

SEQ ID NO: 213 - DNA, 22 bp, Artificial Sequence
  Synthetic polynucleotide
atggaaaacacttacgttggcc

SEQ ID NO: 214 - DNA, 24 bp, Artificial Sequence
  Synthetic polynucleotide
attattagaattccatatggactg

SEQ ID NO: 215 - DNA, 25 bp, Artificial Sequence
  Synthetic polynucleotide
gatggcggattcttcacccgattcg

SEQ ID NO: 216 - DNA, 24 bp, Artificial Sequence
  Synthetic polynucleotide
gtctttcaagagaagacttctacc

SEQ ID NO: 217 - DNA, 20 bp, Artificial Sequence
  Synthetic polynucleotide
atggcggatctcttcggtgg

SEQ ID NO: 218 - DNA, 25 bp, Artificial Sequence
  Synthetic polynucleotide
cgataaaattgaagcccaatctatc

SEQ ID NO: 219 - DNA, 22 bp, Artificial Sequence
  Synthetic polynucleotide
atggtgtctatgctgactaatg

SEQ ID NO: 220 - DNA, 24 bp, Artificial Sequence
  Synthetic polynucleotide
accaaaagaggagtaattgtattg

SEQ ID NO: 221 - DNA, 30 bp, Artificial Sequence
  Synthetic polynucleotide
gatgtcgtttctgagtattgttcgtgatgt

SEQ ID NO: 222 - DNA, 30 bp, Artificial Sequence
  Synthetic polynucleotide
ttcacatgccaatttagtatcaaaggtgct

SEQ ID NO: 223 - DNA, 25 bp, Artificial Sequence
  Synthetic polynucleotide
atggtgaaaacacttcaaaagacac

SEQ ID NO: 224 - DNA, 24 bp, Artificial Sequence
  Synthetic polynucleotide
gcagaagttccataatctgatatc

SEQ ID NO: 225 - DNA, 24 bp, Artificial Sequence
  Synthetic polynucleotide
atgatcagtttcagagaagagaac

SEQ ID NO: 226 - DNA, 26 bp, Artificial Sequence
  Synthetic polynucleotide
taaaaacttatcgatccaatcagtag

SEQ ID NO: 227 - DNA, 30 bp, Artificial Sequence
  Synthetic polynucleotide
gatggcaatgtcttgcaaggatggtaagtt

SEQ ID NO: 228 - DNA, 30 bp, Artificial Sequence
  Synthetic polynucleotide
cacaaaggaccaattgatgaacacaaagca

SEQ ID NO: 229 - DNA, 30 bp, Artificial Sequence
  Synthetic polynucleotide
gatggagagtacagattcttccggtggtcc

SEQ ID NO: 230 - DNA, 30 bp, Artificial Sequence
  Synthetic polynucleotide
agaataccaattcaaaccaggcaattggta

SEQ ID NO: 231 - DNA, 30 bp, Artificial Sequence
  Synthetic polynucleotide
gatgggtatccaagaaactgacccgttaac

SEQ ID NO: 232 - DNA, 30 bp, Artificial Sequence
  Synthetic polynucleotide
cataaacccaaacccaccaacttgccccga

SEQ ID NO: 233 - DNA, 30 bp, Artificial Sequence
  Synthetic polynucleotide
gatgaagagagatcatcatcatcatcatca

SEQ ID NO: 234 - DNA, 21 bp, Artificial Sequence
  Synthetic polynucleotide
atggcgagaatcggatgaagc

SEQ ID NO: 235 - DNA, 25 bp, Artificial Sequence
  Synthetic polynucleotide
gatggagacggaagaagagatgaag

SEQ ID NO: 236 - DNA, 26 bp, Artificial Sequence
  Synthetic polynucleotide
gcaattccaaacagtgcttggaatac

SEQ ID NO: 237 - DNA, 35 bp, Artificial Sequence
  Synthetic polynucleotide
gggatggagggttcgtccaaagggctgcgaaaagg

SEQ ID NO: 238 - DNA, 35 bp, Artificial Sequence
  Synthetic polynucleotide
atcaaatttcacagtctctccatcgaaaagactcc

SEQ ID NO: 239 - DNA, 30 bp, Artificial Sequence
  Synthetic polynucleotide
gatgaagtcaagacgtgaacaatcaatcga

SEQ ID NO: 240 - DNA, 30 bp, Artificial Sequence
  Synthetic polynucleotide
tttatagtaacctcgaatgtgctgggccaa

SEQ ID NO: 241 - DNA, 29 bp, Artificial Sequence
  Synthetic polynucleotide
gatggaaaacatgggggattcgagcatag

SEQ ID NO: 242 - DNA, 27 bp, Artificial Sequence
  Synthetic polynucleotide
tgagtgccagttcatgttaggaagctg

SEQ ID NO: 243 - DNA, 30 bp, Artificial Sequence
  Synthetic polynucleotide
gatgaattcgttttcacaagtacctcctgg

SEQ ID NO: 244 - DNA, 30 bp, Artificial Sequence
  Synthetic polynucleotide
gagatcaatctgacaacttgaagaagtaga

SEQ ID NO: 245 - DNA, 24 bp, Artificial Sequence
  Synthetic polynucleotide
atggctgaccctaacaatcctatc

SEQ ID NO: 246 - DNA, 21 bp, Artificial Sequence
  Synthetic polynucleotide
atagctccacaagctctctcc

SEQ ID NO: 247 - DNA, 30 bp, Artificial Sequence
  Synthetic polynucleotide
gatgggtcatcactcatgctgcaaccagca

SEQ ID NO: 248 - DNA, 30 bp, Artificial Sequence
  Synthetic polynucleotide
aaacgaagaagggaaagaagaagataaggc

SEQ ID NO: 249 - DNA, 25 bp, Artificial Sequence
  Synthetic polynucleotide
atggaagaaagcaatgatatttttc

SEQ ID NO: 250 - DNA, 24 bp, Artificial Sequence
  Synthetic polynucleotide
attggcaagaacttcccaaatcag

SEQ ID NO: 251 - DNA, 21 bp, Artificial Sequence
  Synthetic polynucleotide
atgtcgtcttccaccaatgac

SEQ ID NO: 252 - DNA, 23 bp, Artificial Sequence
  Synthetic polynucleotide
gtttacaaaagagtcttgaatcc

SEQ ID NO: 253 - DNA, 30 bp, Artificial Sequence
  Synthetic polynucleotide
gatggctattgagggtgagaaagagaaacc

SEQ ID NO: 254 - DNA, 30 bp, Artificial Sequence
  Synthetic polynucleotide
tgctaccacatttgtgttcttcaatgtttg

SEQ ID NO: 255 - DNA, 24 bp, Artificial Sequence
  Synthetic polynucleotide
atgtttccttctttcattactcac

SEQ ID NO: 256 - DNA, 25 bp, Artificial Sequence
  Synthetic polynucleotide
attagggtttttagttaacacattg

SEQ ID NO: 257 - DNA, 30 bp, Artificial Sequence
  Synthetic polynucleotide
gatgggaaggggtagggttcaattgaagag

SEQ ID NO: 258 - DNA, 30 bp, Artificial Sequence
  Synthetic polynucleotide
tgcggcgaagcagccaaggttgcagttgta

SEQ ID NO: 259 - DNA, 30 bp, Artificial Sequence
  Synthetic polynucleotide
gatggaagtaacttcccaatctaccctccc

SEQ ID NO: 260 - DNA, 30 bp, Artificial Sequence
  Synthetic polynucleotide
aaacttaaacatcgcttgacgatgatggtt

SEQ ID NO: 261 - DNA, 30 bp, Artificial Sequence
  Synthetic polynucleotide
gatgaacaaaacccgccttcgtgctctctc

SEQ ID NO: 262 - DNA, 30 bp, Artificial Sequence
  Synthetic polynucleotide
tcggaatagaagaagcgtttcttgacctgt

SEQ ID NO: 263 - DNA, 22 bp, Artificial Sequence
  Synthetic polynucleotide
atggctggtcttaggaattccg

SEQ ID NO: 264 - DNA, 22 bp, Artificial Sequence
  Synthetic polynucleotide
agggtcccaaagaaagtcactc

SEQ ID NO: 265 - DNA, 30 bp, Artificial Sequence
  Synthetic polynucleotide
gatggctcgtggaaagattcagcttaagag

SEQ ID NO: 266 - DNA, 30 bp, Artificial Sequence
  Synthetic polynucleotide
gaactgaaatatttcacttggcattgttag

SEQ ID NO: 267 - DNA, 23 bp, Artificial Sequence
  Synthetic polynucleotide
atgtgcggaggagctgtaatttc

SEQ ID NO: 268 - DNA, 22 bp, Artificial Sequence
  Synthetic polynucleotide
ggaccatagacccatgtcattg

SEQ ID NO: 269 - DNA, 27 bp, Artificial Sequence
  Synthetic polynucleotide
atgaagaaatggttgggattttcattg

SEQ ID NO: 270 - DNA, 22 bp, Artificial Sequence
  Synthetic polynucleotide
gtggccggcgccagagctggtg

SEQ ID NO: 271 - DNA, 30 bp, Artificial Sequence
  Synthetic polynucleotide
gatggccgacggtagtactagttcttcgga

SEQ ID NO: 272 - DNA, 30 bp, Artificial Sequence
  Synthetic polynucleotide
agcgactccaatcgtgttgaatgctggatg

SEQ ID NO: 273 - DNA, 22 bp, Artificial Sequence
  Synthetic polynucleotide
atggtgaagcaagcgatgaagg

SEQ ID NO: 274 - DNA, 24 bp, Artificial Sequence
  Synthetic polynucleotide
aaaatcccaaagaatcaaagattc

SEQ ID NO: 275 - DNA, 30 bp, Artificial Sequence
  Synthetic polynucleotide
gatggatgttatggctttgttaacagcttt

SEQ ID NO: 276 - DNA, 30 bp, Artificial Sequence
  Synthetic polynucleotide
actctttgcaaatcgtggcattggctcaat

SEQ ID NO: 277 - DNA, 23 bp, Artificial Sequence
  Synthetic polynucleotide
atgaccgagtcatccattatctc

SEQ ID NO: 278 - DNA, 22 bp, Artificial Sequence
  Synthetic polynucleotide
aggaaaaagggggccaaaattg

SEQ ID NO: 279 - DNA, 26 bp, Artificial Sequence
  Synthetic polynucleotide
gatgatgaaatctggggctgatttgc

SEQ ID NO: 280 - DNA, 27 bp, Artificial Sequence
  Synthetic polynucleotide
gaaagttccctgcctaaccacaagtgg

SEQ ID NO: 281 - DNA, 25 bp, Artificial Sequence
  Synthetic polynucleotide
gatggcagctgctatgaatttgtac

SEQ ID NO: 282 - DNA, 22 bp, Artificial Sequence
  Synthetic polynucleotide
agctagaatcgaatcccaatcg

SEQ ID NO: 283 - DNA, 30 bp, Artificial Sequence
  Synthetic polynucleotide
gatggggaagggaagagcaccttgttgtga

SEQ ID NO: 284 - DNA, 30 bp, Artificial Sequence
  Synthetic polynucleotide
atgtatcatgagctcgtagttcttcaagag

SEQ ID NO: 285 - DNA, 22 bp, Artificial Sequence
  Synthetic polynucleotide
atggaaaacagctacaccgttg

SEQ ID NO: 286 - DNA, 23 bp, Artificial Sequence
  Synthetic polynucleotide
cttcctagacaacaaccctaaac

SEQ ID NO: 287 - DNA, 30 bp, Artificial Sequence
  Synthetic polynucleotide
gatggctgcttcttcatcctccgctgcttc

SEQ ID NO: 288 - DNA, 30 bp, Artificial Sequence
  Synthetic polynucleotide
gaaactcgcatgatggattccataaggtgg

SEQ ID NO: 289 - DNA, 23 bp, Artificial Sequence
  Synthetic polynucleotide
gatggcggcgataggagagaaag

SEQ ID NO: 290 - DNA, 24 bp, Artificial Sequence
  Synthetic polynucleotide
cttaaaaggaatattagtatagtg

SEQ ID NO: 291 - DNA, 24 bp, Artificial Sequence
  Synthetic polynucleotide
gatggtttacggtaagagatcgag

SEQ ID NO: 292 - DNA, 23 bp, Artificial Sequence
  Synthetic polynucleotide
ccaatatatgttaactattggtg

SEQ ID NO: 293 - DNA, 30 bp, Artificial Sequence
  Synthetic polynucleotide
gatggagccaatggaatcttgtagcgttcc

SEQ ID NO: 294 - DNA, 30 bp, Artificial Sequence
  Synthetic polynucleotide
attatcaaatacgcaaatcccaatatcata

SEQ ID NO: 295 - DNA, 24 bp, Artificial Sequence
  Synthetic polynucleotide
atggaaactgcttctctttctttc

SEQ ID NO: 296 - DNA, 24 bp, Artificial Sequence
  Synthetic polynucleotide
agaattggccagtttactaattgc

SEQ ID NO: 297 - DNA, 30 bp, Artificial Sequence
  Synthetic polynucleotide
gatgtctggttcgacccggaaagaaatgga

SEQ ID NO: 298 - DNA, 30 bp, Artificial Sequence
  Synthetic polynucleotide
ctcgatcctacctaatccaataaactctct

SEQ ID NO: 299 - DNA, 30 bp, Artificial Sequence
  Synthetic polynucleotide
gatgggtttagctactacaacttcttctat

SEQ ID NO: 300 - DNA, 30 bp, Artificial Sequence
  Synthetic polynucleotide
aaaatctccaaagtctctaacggagaaaga

SEQ ID NO: 301 - DNA, 30 bp, Artificial Sequence
  Synthetic polynucleotide
gatggatttgatggagaagaacttggagtt

SEQ ID NO: 302 - DNA, 30 bp, Artificial Sequence
  Synthetic polynucleotide
cggtttagttgcaagctgccaaatcttgac

SEQ ID NO: 303 - DNA, 24 bp, Artificial Sequence
  Synthetic polynucleotide
gatgttggatcttaacctcaacgc

SEQ ID NO: 304 - DNA, 23 bp, Artificial Sequence
  Synthetic polynucleotide
agggtgtggataaaagtaaccac

SEQ ID NO: 305 - DNA, 30 bp, Artificial Sequence
  Synthetic polynucleotide
gatggataataccaaccgtcttcgtcttcg

SEQ ID NO: 306 - DNA, 30 bp, Artificial Sequence
  Synthetic polynucleotide
caattttagattttcttggagattaagagg

SEQ ID NO: 307 - DNA, 30 bp, Artificial Sequence
  Synthetic polynucleotide
gatgtttgaagtcaaaatggggtcaaagat

SEQ ID NO: 308 - DNA, 30 bp, Artificial Sequence
  Synthetic polynucleotide
gcttgaaactctcggctcttcacgaacatt

SEQ ID NO: 309 - DNA, 24 bp, Artificial Sequence
  Synthetic polynucleotide
atgtattcatctccaagttcttgg

SEQ ID NO: 310 - DNA, 24 bp, Artificial Sequence
  Synthetic polynucleotide
acatgagctcataagaagttgttc

SEQ ID NO: 311 - DNA, 30 bp, Artificial Sequence
  Synthetic polynucleotide
gatggagaagaggagctctattaaaaacag

SEQ ID NO: 312 - DNA, 30 bp, Artificial Sequence
  Synthetic polynucleotide
tagaaacaaacaaaacttattttcccgata

SEQ ID NO: 313 - DNA, 22 bp, Artificial Sequence
  Synthetic polynucleotide
atgcatagcgggaagagacctc

SEQ ID NO: 314 - DNA, 25 bp, Artificial Sequence
  Synthetic polynucleotide
ttttcgtcgtttgtggatactaatg

SEQ ID NO: 315 - DNA, 21 bp, Artificial Sequence
  Synthetic polynucleotide
atggaacgtgacgactgccgg

SEQ ID NO: 316 - DNA, 24 bp, Artificial Sequence
  Synthetic polynucleotide
gtaactttgagagaggaagggttc

SEQ ID NO: 317 - DNA, 22 bp, Artificial Sequence
  Synthetic polynucleotide
atggaccctttagcttcccaac

SEQ ID NO: 318 - DNA, 24 bp, Artificial Sequence
  Synthetic polynucleotide
atagaattcccccaagatgggatc

SEQ ID NO: 319 - DNA, 21 bp, Artificial Sequence
  Synthetic polynucleotide
gatggcgtcggtgtcgtcgtc

SEQ ID NO: 320 - DNA, 22 bp, Artificial Sequence
  Synthetic polynucleotide
tttctcttgtgggaggtagctg

SEQ ID NO: 321 - DNA, 30 bp, Artificial Sequence
  Synthetic polynucleotide
gatgaagagaacacatttggcaagttttag

SEQ ID NO: 322 - DNA, 30 bp, Artificial Sequence
  Synthetic polynucleotide
gaggtagcctagtcgaagctccaaatcaag

SEQ ID NO: 323 - DNA, 30 bp, Artificial Sequence
  Synthetic polynucleotide
gatggagggtggtgcgagtaatgaagtagc

SEQ ID NO: 324 - DNA, 30 bp, Artificial Sequence
  Synthetic polynucleotide
aacaagttgcagaggtggttggtcttggtt

SEQ ID NO: 325 - DNA, 27 bp, Artificial Sequence
  Synthetic polynucleotide
atgagctcatctgattccgttaataac

SEQ ID NO: 326 - DNA, 27 bp, Artificial Sequence
  Synthetic polynucleotide
tatccgattatcagaataagaacattc

SEQ ID NO: 327 - DNA, 24 bp, Artificial Sequence
  Synthetic polynucleotide
atggcaagacaaatcaacatagag

SEQ ID NO: 328 - DNA, 24 bp, Artificial Sequence
  Synthetic polynucleotide
ttcagatagaaaaaacggctcttc

SEQ ID NO: 329 - DNA, 30 bp, Artificial Sequence
  Synthetic polynucleotide
gatgggaagagggagagtggagatgaagag

SEQ ID NO: 330 - DNA, 30 bp, Artificial Sequence
  Synthetic polynucleotide
aagaacccaaccttggacgaaattagtctc

SEQ ID NO: 331 - DNA, 22 bp, Artificial Sequence
  Synthetic polynucleotide
atggcgacaattcagaagcttg

SEQ ID NO: 332 - DNA, 20 bp, Artificial Sequence
  Synthetic polynucleotide
gtggttcgatgaccgtgctg

SEQ ID NO: 333 - DNA, 23 bp, Artificial Sequence
  Synthetic polynucleotide
atgaaaagccgagtgagaaaatc

SEQ ID NO: 334 - DNA, 25 bp, Artificial Sequence
  Synthetic polynucleotide
ttacttatccaacaaatgatcttgg

SEQ ID NO: 335 - DNA, 30 bp, Artificial Sequence
  Synthetic polynucleotide
gatgatgaacgttaaaccaatggagcagat

SEQ ID NO: 336 - DNA, 30 bp, Artificial Sequence
  Synthetic polynucleotide
ccatgaagatcctcctcctgtagtactgaa

SEQ ID NO: 337 - DNA, 23 bp, Artificial Sequence
  Synthetic polynucleotide
atgtgtgggggagctatcatttc

SEQ ID NO: 338 - DNA, 20 bp, Artificial Sequence
  Synthetic polynucleotide
attggagtcttgatagctcc

SEQ ID NO: 339 - DNA, 30 bp, Artificial Sequence
  Synthetic polynucleotide
gatggagacgacgatgaagaagaaagggag

SEQ ID NO: 340 - DNA, 30 bp, Artificial Sequence
  Synthetic polynucleotide
aatcacatggtggtcaccattaagcaagtg

SEQ ID NO: 341 - DNA, 25 bp, Artificial Sequence
  Synthetic polynucleotide
atgaatatcgtctcttggaaagatg

SEQ ID NO: 342 - DNA, 30 bp, Artificial Sequence
  Synthetic polynucleotide
attggtggagagtttccaagccgaggtggc

SEQ ID NO: 343 - DNA, 30 bp, Artificial Sequence
  Synthetic polynucleotide
gatgggaagaggaagagtagagctcaagag

SEQ ID NO: 344 - DNA, 30 bp, Artificial Sequence
  Synthetic polynucleotide
cagcatccagccagggatgtagccgtttcc

SEQ ID NO: 345 - DNA, 23 bp, Artificial Sequence
  Synthetic polynucleotide
gatggtggaagaaggcggcgtag

SEQ ID NO: 346 - DNA, 25 bp, Artificial Sequence
  Synthetic polynucleotide
gctagtatataaatcttcccagaag

SEQ ID NO: 347 - DNA, 30 bp, Artificial Sequence
  Synthetic polynucleotide
gatgataagcaaggatccaagatcgagttt

SEQ ID NO: 348 - DNA, 30 bp, Artificial Sequence
  Synthetic polynucleotide
gccttgatattgaaggtgagaactcatcat

SEQ ID NO: 349 - DNA, 24 bp, Artificial Sequence
  Synthetic polynucleotide
gatggagaatccggtgggtttaag

SEQ ID NO: 350 - DNA, 25 bp, Artificial Sequence
  Synthetic polynucleotide
tgttcttgagatagaagaacattgg

SEQ ID NO: 351 - DNA, 30 bp, Artificial Sequence
  Synthetic polynucleotide
gatggcttcgagcaacacgactactggggt

SEQ ID NO: 352 - DNA, 30 bp, Artificial Sequence
  Synthetic polynucleotide
tgatttttttgaagatccaaagcccccaaa

SEQ ID NO: 353 - DNA, 30 bp, Artificial Sequence
  Synthetic polynucleotide
gatgagctcgtcgccgtcaagaaatccaac

SEQ ID NO: 354 - DNA, 30 bp, Artificial Sequence
  Synthetic polynucleotide
tgctgatttgtcgcttgttgagttcttgac

SEQ ID NO: 355 - DNA, 26 bp, Artificial Sequence
  Synthetic polynucleotide
gatgggtcgcgaatctgtggctgttg

SEQ ID NO: 356 - DNA, 25 bp, Artificial Sequence
  Synthetic polynucleotide
ttgtccattagcattgttcttcttg

SEQ ID NO: 357 - DNA, 30 bp, Artificial Sequence
  Synthetic polynucleotide
gatggagactctgcatccattctctcacct

SEQ ID NO: 358 - DNA, 30 bp, Artificial Sequence
  Synthetic polynucleotide
agctccggcactgaagacattttctccggc

SEQ ID NO: 359 - DNA, 23 bp, Artificial Sequence
  Synthetic polynucleotide
atgtgtggaggagctataatctc

SEQ ID NO: 360 - DNA, 25 bp, Artificial Sequence
  Synthetic polynucleotide
aaagtctccttccagcatgaaattg

SEQ ID NO: 361 - DNA, 30 bp, Artificial Sequence
  Synthetic polynucleotide
gatgggtctccaagagcttgacccgttagc

SEQ ID NO: 362 - DNA, 30 bp, Artificial Sequence
  Synthetic polynucleotide
aataaacccgaacccactagattgttgacc

SEQ ID NO: 363 - DNA, 30 bp, Artificial Sequence
  Synthetic polynucleotide
gatggagagcaccgattcttccggtggtcc

SEQ ID NO: 364 - DNA, 30 bp, Artificial Sequence
  Synthetic polynucleotide
agaagagtaccaatttaaaccgggtaattg

SEQ ID NO: 365 - DNA, 26 bp, Artificial Sequence
  Synthetic polynucleotide
atgaacaacaacattttcagtactac

SEQ ID NO: 366 - DNA, 25 bp, Artificial Sequence
  Synthetic polynucleotide
actgtgtatagctttagataaaacc

SEQ ID NO: 367 - DNA, 30 bp, Artificial Sequence
  Synthetic polynucleotide
gatgatgtttaatgagatgggaatgtgtgg

SEQ ID NO: 368 - DNA, 30 bp, Artificial Sequence
  Synthetic polynucleotide
gaaccatatggatacatcttgctgcttctg

SEQ ID NO: 369 - DNA, 24 bp, Artificial Sequence
  Synthetic polynucleotide
atgaaatacagaggcgtacgaaag

SEQ ID NO: 370 - DNA, 22 bp, Artificial Sequence
  Synthetic polynucleotide
gcggtttgcgtcgttacaattg

SEQ ID NO: 371 - DNA, 21 bp, Artificial Sequence
  Synthetic polynucleotide
atggagagctcaaacaggagc

SEQ ID NO: 372 - DNA, 24 bp, Artificial Sequence
  Synthetic polynucleotide
tctcttcctttcttctgaatcaag

SEQ ID NO: 373 - DNA, 25 bp, Artificial Sequence
  Synthetic polynucleotide
catggatccatttttaattcagtcc

SEQ ID NO: 374 - DNA, 23 bp, Artificial Sequence
  Synthetic polynucleotide
ccaagtcccactattttcagaag

SEQ ID NO: 375 - DNA, 21 bp, Artificial Sequence
  Synthetic polynucleotide
atggctgaacgaaagaaacgc

SEQ ID NO: 376 - DNA, 21 bp, Artificial Sequence
  Synthetic polynucleotide
tgggcacgcgatattaagagg

SEQ ID NO: 377 - DNA, 30 bp, Artificial Sequence
  Synthetic polynucleotide
gatgagaataaggagaagagatgaaaaaga

SEQ ID NO: 378 - DNA, 30 bp, Artificial Sequence
  Synthetic polynucleotide
aaggcagtactcaacatcaccagaagcaaa

SEQ ID NO: 379 - DNA, 30 bp, Artificial Sequence
  Synthetic polynucleotide
gatggtgaggcctccttgttgtgacaaagg

SEQ ID NO: 380 - DNA, 30 bp, Artificial Sequence
  Synthetic polynucleotide
gaagaaattagtgttttcatccaatagaat

SEQ ID NO: 381 - DNA, 24 bp, Artificial Sequence
  Synthetic polynucleotide
gatggattacaaggtatcaagaag

SEQ ID NO: 382 - DNA, 25 bp, Artificial Sequence
  Synthetic polynucleotide
gaatttccaaacgcaatcaagattc

SEQ ID NO: 383 - DNA, 24 bp, Artificial Sequence
  Synthetic polynucleotide
atggattcgaaaaatggaattaac

SEQ ID NO: 384 - DNA, 23 bp, Artificial Sequence
  Synthetic polynucleotide
aactgtggttgtggctgttgttg

SEQ ID NO: 385 - DNA, 30 bp, Artificial Sequence
  Synthetic polynucleotide
gatgggagctccaaagctgaagtggacacc

SEQ ID NO: 386 - DNA, 30 bp, Artificial Sequence
  Synthetic polynucleotide
ccgagtttggctatgcattctatacttcac

SEQ ID NO: 387 - DNA, 23 bp, Artificial Sequence
  Synthetic polynucleotide
atgaagaagcgcttaaccacttc

SEQ ID NO: 388 - DNA, 25 bp, Artificial Sequence
  Synthetic polynucleotide
gaccaaatagttacaagaaaccgag

SEQ ID NO: 389 - DNA, 30 bp, Artificial Sequence
  Synthetic polynucleotide
gatgaacatatcagtaaacggacagtcaca

SEQ ID NO: 390 - DNA, 30 bp, Artificial Sequence
  Synthetic polynucleotide
tccactaccgttcaacaagtggcatgtcgt

SEQ ID NO: 391 - DNA, 30 bp, Artificial Sequence
  Synthetic polynucleotide
gatggataaccatcgcaggactaagcaacc

SEQ ID NO: 392 - DNA, 30 bp, Artificial Sequence
  Synthetic polynucleotide
atttttcatgacccaaaacctctcaatttc

SEQ ID NO: 393 - DNA, 22 bp, Artificial Sequence
  Synthetic polynucleotide
gatggtgaaagatctggttggg

SEQ ID NO: 394 - DNA, 24 bp, Artificial Sequence
  Synthetic polynucleotide
tctctcgcgatcaaacttcatcgc

SEQ ID NO: 395 - DNA, 21 bp, Artificial Sequence
  Synthetic polynucleotide
atgattggagatctaatgaag

SEQ ID NO: 396 - DNA, 21 bp, Artificial Sequence
  Synthetic polynucleotide
gttcttgcctttacccttatg

SEQ ID NO: 397 - DNA, 22 bp, Artificial Sequence
  Synthetic polynucleotide
atggcttttggcaatatccaag

SEQ ID NO: 398 - DNA, 22 bp, Artificial Sequence
  Synthetic polynucleotide
aaaagaagataataacgtctcc

SEQ ID NO: 399 - DNA, 22 bp, Artificial Sequence
  Synthetic polynucleotide
atggaagcggagaagaaaatgg

SEQ ID NO: 400 - DNA, 22 bp, Artificial Sequence
  Synthetic polynucleotide
aacagctaaaagaggatccgac

SEQ ID NO: 401 - DNA, 30 bp, Artificial Sequence
  Synthetic polynucleotide
gatgggttccaattttcattacacaataga

SEQ ID NO: 402 - DNA, 30 bp, Artificial Sequence
  Synthetic polynucleotide
cccgtgaaccattccgtgcgatagagccat

SEQ ID NO: 403 - DNA, 25 bp, Artificial Sequence
  Synthetic polynucleotide
atgatgatggatgagtttatggatc

SEQ ID NO: 404 - DNA, 22 bp, Artificial Sequence
  Synthetic polynucleotide
cacaagtaagagatcggatatc

SEQ ID NO: 405 - DNA, 25 bp, Artificial Sequence
  Synthetic polynucleotide
atggactttgacgaggagctaaatc

SEQ ID NO: 406 - DNA, 23 bp, Artificial Sequence
  Synthetic polynucleotide
aaagaaaggcctcataggacaag

SEQ ID NO: 407 - DNA, 25 bp, Artificial Sequence
  Synthetic polynucleotide
gatgggtttgaaagatattgggtcc

SEQ ID NO: 408 - DNA, 25 bp, Artificial Sequence
  Synthetic polynucleotide
ttggaaagcgaggatattttcggtc

SEQ ID NO: 409 - DNA, 23 bp, Artificial Sequence
  Synthetic polynucleotide
atgccaccctctcctcctaaatc

SEQ ID NO: 410 - DNA, 25 bp, Artificial Sequence
  Synthetic polynucleotide
gtttatccaatcaatgtccatcatg

SEQ ID NO: 411 - DNA, 30 bp, Artificial Sequence
  Synthetic polynucleotide
gatggaggaaggaacttcaggttcacggag

SEQ ID NO: 412 - DNA, 30 bp, Artificial Sequence
  Synthetic polynucleotide
ctcgatttcttgtggaacttcatgaagcct

SEQ ID NO: 413 - DNA, 21 bp, Artificial Sequence
  Synthetic polynucleotide
atggcggattcgtcttccgac

SEQ ID NO: 414 - DNA, 22 bp, Artificial Sequence
  Synthetic polynucleotide
gggaaaatgtttccaagattcg

SEQ ID NO: 415 - DNA, 24 bp, Artificial Sequence
  Synthetic polynucleotide
atgcattatcctaacaacagaacc

SEQ ID NO: 416 - DNA, 26 bp, Artificial Sequence
  Synthetic polynucleotide
ctggaacatatcagcaattgtatttc

SEQ ID NO: 417 - DNA, 25 bp, Artificial Sequence
  Synthetic polynucleotide
gatgctgcagtctgcagcaccagag

SEQ ID NO: 418 - DNA, 26 bp, Artificial Sequence
  Synthetic polynucleotide
tgaactcaccagtgtcctccatatac

SEQ ID NO: 419 - DNA, 30 bp, Artificial Sequence
  Synthetic polynucleotide
gatggaatcggtggatcaatcatgtagtgt

SEQ ID NO: 420 - DNA, 30 bp, Artificial Sequence
  Synthetic polynucleotide
aacatgtaaatccctatataagtcatagtc

SEQ ID NO: 421 - DNA, 25 bp, Artificial Sequence
  Synthetic polynucleotide
atgaagtctttttgtgataatgatg

SEQ ID NO: 422 - DNA, 27 bp, Artificial Sequence
  Synthetic polynucleotide
agaatcagcccaagcagcgaaaaccgg

SEQ ID NO: 423 - DNA, 30 bp, Artificial Sequence
  Synthetic polynucleotide
gatgggaaggtcaccgtgctgtgagaaagc

SEQ ID NO: 424 - DNA, 30 bp, Artificial Sequence
  Synthetic polynucleotide
tttcatctccaagcttcgaaagcccaaaag

SEQ ID NO: 425 - DNA, 27 bp, Artificial Sequence
  Synthetic polynucleotide
atggcagccatagatatgttcaatagc

SEQ ID NO: 426 - DNA, 24 bp, Artificial Sequence
  Synthetic polynucleotide
agattcggacaatttgctaatcgc

SEQ ID NO: 427 - DNA, 30 bp, Artificial Sequence
  Synthetic polynucleotide
gatggttttttcttcatttcctacttatcc

SEQ ID NO: 428 - DNA, 30 bp, Artificial Sequence
  Synthetic polynucleotide
tatattgctagtagaagaagaactgaaatt

SEQ ID NO: 429 - DNA, 30 bp, Artificial Sequence
  Synthetic polynucleotide
gatgagttacacgagcactgacagtgacca

SEQ ID NO: 430 - DNA, 30 bp, Artificial Sequence
  Synthetic polynucleotide
acaaactatttcaagtgatggtaaggtgaa

SEQ ID NO: 431 - DNA, 23 bp, Artificial Sequence
  Synthetic polynucleotide
atggcgaattcaggaaattatgg

SEQ ID NO: 432 - DNA, 23 bp, Artificial Sequence
  Synthetic polynucleotide
aaaaccagaattaggaggtgaag

SEQ ID NO: 433 - DNA, 21 bp, Artificial Sequence
  Synthetic polynucleotide
atggcgagttttgaggaaagc

SEQ ID NO: 434 - DNA, 23 bp, Artificial Sequence
  Synthetic polynucleotide
aaatgcatcacaggaagatgaag

SEQ ID NO: 435 - DNA, 24 bp, Artificial Sequence
  Synthetic polynucleotide
gatggatttgcctcctggttttag

SEQ ID NO: 436 - DNA, 24 bp, Artificial Sequence
  Synthetic polynucleotide
gtaattccagaaaggttcaagatc

SEQ ID NO: 437 - DNA, 30 bp, Artificial Sequence
  Synthetic polynucleotide
gatgtcaagaaagccatgttgtgtgggaga

SEQ ID NO: 438 - DNA, 30 bp, Artificial Sequence
  Synthetic polynucleotide
tatgaagttcttgtcgtcgtaatcttggct

SEQ ID NO: 439 - DNA, 24 bp, Artificial Sequence
  Synthetic polynucleotide
atgggaataaaaaaagaagatcag

SEQ ID NO: 440 - DNA, 22 bp, Artificial Sequence
  Synthetic polynucleotide
ctcgatatggtctggttgtgag

SEQ ID NO: 441 - DNA, 30 bp, Artificial Sequence
  Synthetic polynucleotide
gatgaagtcggagctaaatttaccagctgg

SEQ ID NO: 442 - DNA, 30 bp, Artificial Sequence
  Synthetic polynucleotide
cccctgtggagcaaaactccaattcaagaa

SEQ ID NO: 443 - DNA, 30 bp, Artificial Sequence
  Synthetic polynucleotide
gatggggaaaactcaactcgctcctggatt

SEQ ID NO: 444 - DNA, 30 bp, Artificial Sequence
  Synthetic polynucleotide
catttttggtctatgtctcatggaagcaga

SEQ ID NO: 445 - DNA, 30 bp, Artificial Sequence
  Synthetic polynucleotide
gatggataatgtcaaacttgttaagaatgg

SEQ ID NO: 446 - DNA, 30 bp, Artificial Sequence
  Synthetic polynucleotide
tctgaaactattgcaactactggtctcttc

SEQ ID NO: 447 - DNA, 20 bp, Artificial Sequence
  Synthetic polynucleotide
atggtctccgctctcagccg

SEQ ID NO: 448 - DNA, 25 bp, Artificial Sequence
  Synthetic polynucleotide
ttctcttgggtagttataataattg

SEQ ID NO: 449 - DNA, 24 bp, Artificial Sequence
  Synthetic polynucleotide
atgaacacaacatcatcaaagagc

SEQ ID NO: 450 - DNA, 24 bp, Artificial Sequence
  Synthetic polynucleotide
ggagccaaagtagttgaaaccttg

SEQ ID NO: 451 - DNA, 26 bp, Artificial Sequence
  Synthetic polynucleotide
gatggaggtggagaagaggattgtag

SEQ ID NO: 452 - DNA, 23 bp, Artificial Sequence
  Synthetic polynucleotide
ctcatcagctgaggtaggaggag

SEQ ID NO: 453 - DNA, 24 bp, Artificial Sequence
  Synthetic polynucleotide
gatggcggttgtggttgaagaagg

SEQ ID NO: 454 - DNA, 22 bp, Artificial Sequence
  Synthetic polynucleotide
gaagtcccacaagtcccccctc

SEQ ID NO: 455 - DNA, 22 bp, Artificial Sequence
  Synthetic polynucleotide
atgggttttgctctgatccacc

SEQ ID NO: 456 - DNA, 23 bp, Artificial Sequence
  Synthetic polynucleotide
aaagactgagtagaagcctgtag

SEQ ID NO: 457 - DNA, 30 bp, Artificial Sequence
  Synthetic polynucleotide
gatgtcttctctgtcgcaatcgccaccacc

SEQ ID NO: 458 - DNA, 30 bp, Artificial Sequence
  Synthetic polynucleotide
aattttgtgtaccaatctcattcggattgc

SEQ ID NO: 459 - DNA, 27 bp, Artificial Sequence
  Synthetic polynucleotide
gatggacacgaaggcggttggagtttc

SEQ ID NO: 460 - DNA, 25 bp, Artificial Sequence
  Synthetic polynucleotide
ttctagataaaacaacattgctatc

SEQ ID NO: 461 - DNA, 30 bp, Artificial Sequence
  Synthetic polynucleotide
gatggccgatgaggtcacaatcgggtttcg

SEQ ID NO: 462 - DNA, 30 bp, Artificial Sequence
  Synthetic polynucleotide
aggccaagtcagctgttcccagtcccacat

SEQ ID NO: 463 - DNA, 30 bp, Artificial Sequence
  Synthetic polynucleotide
gatgggtagagggaagatagagataaagaa

SEQ ID NO: 464 - DNA, 30 bp, Artificial Sequence
  Synthetic polynucleotide
atcattctgggccgttggatcgttttgaag

SEQ ID NO: 465 - DNA, 30 bp, Artificial Sequence
  Synthetic polynucleotide
gatggataattcagctccagattcgttatc

SEQ ID NO: 466 - DNA, 30 bp, Artificial Sequence
  Synthetic polynucleotide
aactctaaggagctgcattttgttagcaaa

SEQ ID NO: 467 - DNA, 27 bp, Artificial Sequence
  Synthetic polynucleotide
gatgaaagaagacatggaagtactatc

SEQ ID NO: 468 - DNA, 25 bp, Artificial Sequence
  Synthetic polynucleotide
tgcgactagactgcagaccgacatc

SEQ ID NO: 469 - DNA, 21 bp, Artificial Sequence
  Synthetic polynucleotide
atggcacgaccacaacaacgc

SEQ ID NO: 470 - DNA, 23 bp, Artificial Sequence
  Synthetic polynucleotide
cagcgtctgagttggtaaaacag

SEQ ID NO: 471 - DNA, 23 bp, Artificial Sequence
  Synthetic polynucleotide
atggtacattcgaagaagttccg

SEQ ID NO: 472 - DNA, 20 bp, Artificial Sequence
  Synthetic polynucleotide
gacctgtgcaatggatccag

SEQ ID NO: 473 - DNA, 24 bp, Artificial Sequence
  Synthetic polynucleotide
atgatagcttcagagagtaccaag

SEQ ID NO: 474 - DNA, 26 bp, Artificial Sequence
  Synthetic polynucleotide
ataattatacagtccttgaagatccc

SEQ ID NO: 475 - DNA, 30 bp, Artificial Sequence
  Synthetic polynucleotide
gatgggaaagagagcaactactagtgtgag

SEQ ID NO: 476 - DNA, 30 bp, Artificial Sequence
  Synthetic polynucleotide
acaagtgaagtctcggagccaatcttcatc

SEQ ID NO: 477 - DNA, 25 bp, Artificial Sequence
  Synthetic polynucleotide
gatggattacgaggcatcaagaatc

SEQ ID NO: 478 - DNA, 24 bp, Artificial Sequence
  Synthetic polynucleotide
gaaattccaaacgcaatccaattc

SEQ ID NO: 479 - DNA, 25 bp, Artificial Sequence
  Synthetic polynucleotide
atgagaatgacaagagatggaaaag

SEQ ID NO: 480 - DNA, 32 bp, Artificial Sequence
  Synthetic polynucleotide
aaggcaatacccattagtaaaatccatcatag

SEQ ID NO: 481 - DNA, 21 bp, Artificial Sequence
  Synthetic polynucleotide
atggtcatggagcccaagaag

SEQ ID NO: 482 - DNA, 22 bp, Artificial Sequence
  Synthetic polynucleotide
tgaaccattttcctctgcactc

SEQ ID NO: 483 - DNA, 30 bp, Artificial Sequence
  Synthetic polynucleotide
gatggagtgtaatgcaaagccaccgtttca

SEQ ID NO: 484 - DNA, 30 bp, Artificial Sequence
  Synthetic polynucleotide
gttataaaactggttcaagctgaagtagtt

SEQ ID NO: 485 - DNA, 29 bp, Artificial Sequence
  Synthetic polynucleotide
gatgtacggacagtgcaatatagaatccg

SEQ ID NO: 486 - DNA, 27 bp, Artificial Sequence
  Synthetic polynucleotide
tgaaaccaataactcatcaacacgtgt

SEQ ID NO: 487 - DNA, 24 bp, Artificial Sequence
  Synthetic polynucleotide
ggggatggcgactcctaacgaagt

SEQ ID NO: 488 - DNA, 29 bp, Artificial Sequence
  Synthetic polynucleotide
aacaacggtcaactgggaataaccaaacg

SEQ ID NO: 489 - DNA, 30 bp, Artificial Sequence
  Synthetic polynucleotide
gatgactcgtcgatgttctcactgcaatca

SEQ ID NO: 490 - DNA, 30 bp, Artificial Sequence
  Synthetic polynucleotide
taaagcgtgtatcacgcttttgatgtctga

SEQ ID NO: 491 - DNA, 24 bp, Artificial Sequence
  Synthetic polynucleotide
atggcttcttcacatcaacaacag

SEQ ID NO: 492 - DNA, 23 bp, Artificial Sequence
  Synthetic polynucleotide
agtaactacgagttgagagtgtc

SEQ ID NO: 493 - DNA, 26 bp, Artificial Sequence
  Synthetic polynucleotide
atgtcgaataataataattctccgac

SEQ ID NO: 494 - DNA, 27 bp, Artificial Sequence
  Synthetic polynucleotide
tttataactccaaagattatctccttc

SEQ ID NO: 495 - DNA, 25 bp, Artificial Sequence
  Synthetic polynucleotide
atggacgaatatattgatttccgac

SEQ ID NO: 496 - DNA, 26 bp, Artificial Sequence
  Synthetic polynucleotide
agcaactaatagatctgatatcaatg

SEQ ID NO: 497 - DNA, 30 bp, Artificial Sequence
  Synthetic polynucleotide
gatgggaaaatcttcaagctcggaggaaag

SEQ ID NO: 498 - DNA, 30 bp, Artificial Sequence
  Synthetic polynucleotide
tgatagattcaaagcattattattatgatc

SEQ ID NO: 499 - DNA, 30 bp, Artificial Sequence
  Synthetic polynucleotide
gatggaggttatgagaccgtcgacgtcaca

SEQ ID NO: 500 - DNA, 30 bp, Artificial Sequence
  Synthetic polynucleotide
tagttgaaacattgtgttttgggcgtcata

SEQ ID NO: 501 - DNA, 22 bp, Artificial Sequence
  Synthetic polynucleotide
atgagatcaggagaatgtgatg

SEQ ID NO: 502 - DNA, 23 bp, Artificial Sequence
  Synthetic polynucleotide
agaatctgattcattatcgctac

SEQ ID NO: 503 - DNA, 25 bp, Artificial Sequence
  Synthetic polynucleotide
atggcaactaaacaagaagctttag

SEQ ID NO: 504 - DNA, 22 bp, Artificial Sequence
  Synthetic polynucleotide
agtgacggagataacggaaaag

SEQ ID NO: 505 - DNA, 30 bp, Artificial Sequence
  Synthetic polynucleotide
gatggaaagtctcgcacacattcctcccgg

SEQ ID NO: 506 - DNA, 30 bp, Artificial Sequence
  Synthetic polynucleotide
cgtgtgtgtattttgagcccaagagtagaa

SEQ ID NO: 507 - DNA, 25 bp, Artificial Sequence
  Synthetic polynucleotide
gatgaatctaccaccgggatttagg

SEQ ID NO: 508 - DNA, 24 bp, Artificial Sequence
  Synthetic polynucleotide
cggtaagcttacttcgtcaagatc

SEQ ID NO: 509 - DNA, 25 bp, Artificial Sequence
  Synthetic polynucleotide
atgtgtgtcttaaaagtggcaaatc

SEQ ID NO: 510 - DNA, 22 bp, Artificial Sequence
  Synthetic polynucleotide
ggaggatggactattattgtag

SEQ ID NO: 511 - DNA, 30 bp, Artificial Sequence
  Synthetic polynucleotide
gatgatgaaggttgatcaagattattcgtg

SEQ ID NO: 512 - DNA, 30 bp, Artificial Sequence
  Synthetic polynucleotide
gtcttctccactcatcaaaaattgagacgc

SEQ ID NO: 513 - DNA, 22 bp, Artificial Sequence
  Synthetic polynucleotide
atggataattcagaaaatgttc

SEQ ID NO: 514 - DNA, 20 bp, Artificial Sequence
  Synthetic polynucleotide
tctccaccgccgtttaattc

SEQ ID NO: 515 - DNA, 30 bp, Artificial Sequence
  Synthetic polynucleotide
gatggctgataggatcaaaggtccatggag

SEQ ID NO: 516 - DNA, 30 bp, Artificial Sequence
  Synthetic polynucleotide
ctcgattctcccaactccaatttgactcat

SEQ ID NO: 517 - DNA, 30 bp, Artificial Sequence
  Synthetic polynucleotide
gatgggtgcaccaaagcagaagtggacacc

SEQ ID NO: 518 - DNA, 30 bp, Artificial Sequence
  Synthetic polynucleotide
ccaaggatgattacggatcctgaacttcaa

SEQ ID NO: 519 - protein, 13 aa, Artificial Sequence
  Synthetic polypeptide
GLDLDLELRLGFA

SEQ ID NO: 520 - protein, 21 aa, Artificial Sequence
  Synthetic polypeptide
  misc_feature (1)..(10): Xaa is any amino acid
  misc_feature (14)..(14): Xaa is Asn or Glu
  misc_feature (16)..(21): Xaa is any amino acid
XXXXXXXXXXLDLXLXXXXXX

SEQ ID NO: 521 - protein, 21 aa, Artificial Sequence
  Synthetic polypeptide
  misc_feature (1)..(10): Xaa is any amino acid
  misc_feature (15)..(15): Xaa is Phe or Ile
  misc_feature (16)..(21): Xaa is any amino acid
XXXXXXXXXXFDLNXXXXXXX

SEQ ID NO: 522 - protein, 19 aa, Artificial Sequence
  Synthetic polypeptide
  misc_feature (6)..(6): Xaa is Glu, Gln or Asp
  misc_feature (10)..(19): Xaa is any amino acid
LDLDLXLRLXXXXXXXXXX

SEQ ID NO: 523 - protein, 6 aa, Artificial Sequence
  Synthetic polypeptide
  misc_feature (1)..(1): Xaa is Asp, Asn, Glu, Gln, Thr or Ser
  misc_feature (3)..(3): Xaa is Asp, Gln, Asn, Arg, Glu, Thr, Ser or His
  misc_feature (5)..(5): Xaa is Arg, Gln, Asn, Thr, Ser, His, Lys or Asp
XLXLXL

SEQ ID NO: 524 - protein, 6 aa, Artificial Sequence
  Synthetic polypeptide
  misc_feature (1)..(1): Xaa is Asp, Asn, Glu, Gln, Thr or Ser
  misc_feature (3)..(3): Xaa is Asp, Gln, Asn, Arg, Glu, Thr, Ser or His
  misc_feature (5)..(5): Xaa is Gln, Asn, Thr, Ser, His, Lys or Asp
XLXLXL

SEQ ID NO: 525 - protein, 6 aa, Artificial Sequence
  Synthetic polypeptide
  misc_feature (1)..(1): Xaa is Asp, Asn, Glu, Gln, Thr or Ser
  misc_feature (3)..(3): Xaa is Asn, Arg, Thr, Ser or His
XLXLRL

SEQ ID NO: 526 - protein, 6 aa, Artificial Sequence
  Synthetic polypeptide
  misc_feature (1)..(1): Xaa is Asn, Glu, Gln, Thr or Ser
  misc_feature (3)..(3): Xaa is Asp, Gln, Asn, Arg, Glu, Thr, Ser or His
XLXLRL

The invention claimed is:

1. A method for significantly improving oil productivity in and individual seed, as compared to a seed from a plant not comprising the chimeric protein, by causing expression of a chimeric protein obtained by fusing a transcription factor consisting of any one of the following proteins (a) to (b) and a functional peptide capable of converting an arbitrary transcription factor into a transcriptional repressor in a plant:
   (a) a protein comprising the amino acid sequence of SEQ ID NO:4; and
   (b) a protein having transactivation activity and comprising an amino acid sequence that has a deletion, a substitution, an addition, or an insertion, of one to ten amino acids with respect to SEQ ID NO:4.

2. The method according to claim 1, wherein transactivation activity of the transcription factor is repressed.

3. The method according to claim 1, wherein the chimeric protein has transcriptional repressor activity.

4. The method according to claim 1, wherein the functional peptide has an amino acid sequence expressed by any one of the following formulae (1) to (8):
   (1) X1-Leu-Asp-Leu-X2-Leu-X3 (SEQ ID NO: 520 with deletion of 0-10 residues from the N-terminus) (where X1 denotes a set of 0 to 10 amino acid residues, X2 denotes Asn or Glu, and X3 denotes a set of at least 6 amino acid residues);
   (2) Y1-Phe-Asp-Leu-Asn-Y2-Y3 (SEQ ID NO: 521 with deletion of 0-10 residues from the N-terminus) (where Y1 denotes a set of 0 to 10 amino acid residues, Y2 denotes Phe or Ile, and Y3 denotes a set of at least 6 amino acid residues);
   (3) Z1-Asp-Leu-Z2-Leu-Arg-Leu-Z3 (SEQ ID NO: 522 with deletion of 0-10 residues from the C-terminus and deletion of 0-2 residues from the N-terminus) (where Z1 denotes Leu, Asp-Leu, or Leu-Asp-Leu, Z2 denotes Glu, Gln, or Asp, and Z3 denotes a set of 0 to 10 amino acid residues);
   (4) Asp-Leu-Z4-Leu-Arg-Leu (residues 4-9 of SEQ ID NO: 522) (where Z4 denotes Glu, Gln, or Asp);

$$\text{(5) } \alpha1\text{-Leu-}\beta1\text{-Leu-}\gamma1\text{-Leu;} \quad \text{(SEQ ID NO: 523)}$$

$$\text{(6) } \alpha1\text{-Leu-}\beta1\text{-Leu-}\gamma2\text{-Leu;} \quad \text{(SEQ ID NO: 524)}$$

$$\text{(7) } \alpha1\text{-Leu-}\beta2\text{-Leu-Arg-Leu;} \quad \text{(SEQ ID NO: 525)}$$

and $$\text{(8) } \alpha2\text{-Leu-}\beta1\text{-Leu-Arg-Leu} \quad \text{(SEQ ID NO: 526)}$$

(where $\alpha1$ denotes Asp, Asn, Glu, Gln, Thr, or Ser, $\alpha2$ denotes Asn, Glu, Gln, Thr, or Ser, $\beta1$ denotes Asp, Gln, Asn, Arg, Glu, Thr, Ser, or His, $\beta2$ denotes Asn, Arg, Thr, Ser, or His, $\gamma1$ denotes Arg, Gln, Asn, Thr, Ser, His, Lys, or Asp, and $\gamma2$ denotes Gln, Asn, Thr, Ser, His, Lys, or Asp in formulae (5) to (8)).

5. The method according to claim 1, wherein the plant is an angiosperm.

6. The method according to claim 1, wherein the plant is a dicotyledon.

7. The method according to claim 1, wherein the plant is a cruciferous plant.

8. The method according to claim 1, wherein the plant is *Arabidopsis thaliana*.

* * * * *